US007833706B2

(12) United States Patent
Begovich et al.

(10) Patent No.: US 7,833,706 B2
(45) Date of Patent: Nov. 16, 2010

(54) GENETIC POLYMORPHISMS ASSOCIATED WITH RHEUMATOID ARTHRITIS, METHODS OF DETECTION AND USES THEREOF

(75) Inventors: Ann Bethea Begovich, El Cerrito, CA (US); Victoria Elizabeth Hope Carlton, San Francisco, CA (US); Steven Jon Schrodi, Livermore, CA (US); Heather Camille Alexander, Alameda, CA (US)

(73) Assignee: Celera Corporation, Alameda, CA (US)

( * ) Notice: Subject to any disclaimer, the term of this patent is extended or adjusted under 35 U.S.C. 154(b) by 866 days.

(21) Appl. No.: 10/767,471

(22) Filed: Jan. 30, 2004

(65) Prior Publication Data

US 2007/0031846 A1 Feb. 8, 2007

Related U.S. Application Data

(60) Provisional application No. 60/443,566, filed on Jan. 30, 2003, provisional application No. 60/455,444, filed on Mar. 18, 2003, provisional application No. 60/465,241, filed on Apr. 25, 2003, provisional application No. 60/495,115, filed on Aug. 15, 2003, provisional application No. 60/519,270, filed on Nov. 13, 2003.

(51) Int. Cl.
C12Q 1/68 (2006.01)
C12P 19/34 (2006.01)
C07H 21/02 (2006.01)
C07H 21/04 (2006.01)

(52) U.S. Cl. .................... 435/6; 435/91.2; 536/23.1; 536/24.33; 536/24.3

(58) Field of Classification Search ................ None
See application file for complete search history.

(56) References Cited

FOREIGN PATENT DOCUMENTS

WO WO 99/36548 A 7/1999
WO WO 01/11084 A 2/2001
WO WO 02/074989 A 9/2002

OTHER PUBLICATIONS

Ittah M et al 'No evidence for an association between the -871 T/C promoter polymorphism in the B-cell-activating factor gene and primary Sjogren's syndrome.' Arthritis Res Ther. 2006;8(1):457-458.*
Vandiedonck C et al 'Association of the PTPN22*R620W polymorphism with autoimmune myasthenia gravis. Ann Neurol. Feb. 2006;59(2):404-7.*
Hacker UT et al 'Lack of association between an interleukin-1 receptor antagonist gene polymorphism and ulcerative colitis.' Gut. May 1997;40(5):623-7.*
GenBank GI:14970654 'Human DNA sequence from clone RP5-1073O3 on chromosome 1p13.1-13.3, complete sequence' 2001, pp. 1-51.*
Criswell LA et al 'Analysis of families in the multiple autoimmune disease genetics consortium (MADGC) collection: the PTPN22 620W allele associates with multiple autoimmune phenotypes.' Am J Hum Genet. Apr. 2005;76(4):561-71.*
Begovich AB et al 'A missense single-nucleotide polymorphism in a gene encoding a protein tyrosine phosphatase (PTPN22) is associated with rheumatoid arthritis.' Am J Hum Genet. Aug. 2004;75(2):330-7.*
Lee AT et al 'The PTPN22 R620W polymorphism associates with RF positive rheumatoid arthritis in a dose-dependent manner but not with HLA-SE status.' Genes Immun. Mar. 2005;6(2):129-33.*
Harrison P et al 'Effects of PTPN22 C1858T polymorphism on susceptibility and clinical characteristics of British Caucasian rheumatoid arthritis patients.' Rheumatology (Oxford). Aug. 2006;45(8):1009-11.*
Database Genbank Retrieved on Dec. 7, 2004 Jul. 6, 2000, "Human DNA Sequence from Clone RP11-179A5 on Chromosome 1" Database Accession No. AL365225.
Morgan, Ann W. et al., "Fcgamma Receptor Type IIIA is associated with Rheumatoid Arthritis in Two Distinct Ethnic Groups", Arthritis and Rheumatism, vol. 43, No. 10, Oct. 2000, pp. 2328-2334.
Waldon-Lynch F. et al., "Tumour Necrosis Factor 5' Promoter Single Nucleotide Polymorphisms Influence Susceptibility to Reheumatoid Arthritis (RA) in Immunogenetically Defined Multiplex RA Families", Genes and Immunity, Apr. 2001, pp. 82-87.
Yamada, R. et al., "Association between a Single-Nucleotide Polymorphism in the Promoter of the Human Interleukin-3 Gene and Rheumatoid Arthritis in Japanese Patients and Maximum-Likelihood Estimation of . . . Effect that Two Genetic Loci Have on Susceptibility to the Diseases", American Journal of Human Genetics, American Society of Human Genetics, Chicago, IL, U.S., vol. 68, No. 3, 2001, pp. 674-685.
International Search Report dated Oct. 19, 2004.
Written Opinion dated Oct. 19, 2004.
Van Oene, Mark, et al., "Association of the Lymphoid Tyrosine Phosphatase R620W variant with Rheumatoid Arthritis, but not Crohn's Disease, in Canadian Populations," Arthritis and Rheumatism, vol. 52, No. 7, Jul. 2005, pp. 193-198.
Siminovitch, K. A.,"PTPN 22 and Autoimmune Disease," Nature Genetics, vol. 36, No. 12, Dec. 2004, pp. 1248-1249.
Database DBSNP [Online] National Institutes of Health, USA; Assay for Reference SNP Id rs2476601, Sep. 24, 2001, "Submitted SNP Report ss3470759", XP002457273 retrieved from NCBI Database Acession No. ss3470759.
European Search Report, Nov. 29, 2007, pp. 1-5.

* cited by examiner

*Primary Examiner*—Stephen Kapushoc

(57) ABSTRACT

The present invention is based on the discovery of genetic polymorphisms that are associated with rheumatoid arthritis. In particular, the present invention relates to nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

20 Claims, 1 Drawing Sheet

GENETIC POLYMORPHISMS ASSOCIATED WITH RHEUMATOID ARTHRITIS, METHODS OF DETECTION AND USES THEREOF

FIELD OF THE INVENTION

The present invention is in the field of diagnosis and therapy of autoimmune diseases. In particular, the present invention relates to specific single nucleotide polymorphisms (SNPs) in the human genome, and their association with rheumatoid arthritis and related pathologies such as other autoimmune diseases. Based on differences in allele frequencies in the rheumatoid arthritis patient population relative to normal individuals, the naturally-occurring SNPs disclosed herein can be used as targets for the design of diagnostic reagents and the development of therapeutic agents, as well as for disease association and linkage analysis. In particular, the SNPs of the present invention are useful for identifying an individual who is at an increased or decreased risk of developing rheumatoid arthritis and for early detection of the disease, for providing clinically important information for the prevention and/or treatment of rheumatoid arthritis, and for screening and selecting therapeutic agents. The SNPs disclosed herein are also useful for human identification applications. Methods, assays, kits, and reagents for detecting the presence of these polymorphisms and their encoded products are provided.

BACKGROUND OF THE INVENTION

Autoimmune Diseases & Rheumatoid Arthritis

Autoimmune diseases are a major health issue, occurring in up to 3% of the general population (Cooper & Stroehla, 2003, *Autoimmunity Rev.* 2:119-125). Although the clinical phenotypes of these diseases are distinct, they share certain common elements, including geographical distributions, population frequencies, therapeutic strategies, and some clinical features which suggest potential similarities in the underlying mechanisms of these diseases. Furthermore, the co-association of multiple autoimmune diseases in the same individual or family supports the presence of common environmental and genetic factors that predispose an individual to autoimmunity (Vyse & Todd; 1996, *Cell* 85:311-318; Cooper & Stroehla, 2003, *Autoimmunity Rev.* 2:119-125; Ueda et al., 2003, *Nature* 423:506-511).

While the major histocompatability complex (MHC) is a known susceptibility locus for many autoimmune diseases, a recent comparison of 23 autoimmune or inflammatory genome-wide scans or linkage studies have uncovered a clustering of non-MHC susceptibility candidate loci (Becker et al., 1998, *Proc. Natl. Acad. Sci. USA* 95:9979-9984; Jawaheer et al., 2001, *Am. J. Human Genet.* 68:927-936). Examples of autoimmune diseases are rheumatoid arthritis, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis.

Rheumatoid arthritis (RA) is one of the most common autoimmune inflammatory disorders, with a prevalence of between 0.5-1% in most adult populations. It is found worldwide and affects all ethnic groups, although it is more common in Europe and the United States than in Asia (Abdel-Nasser et al., 1997, *Semin. Arthritis Rheum.* 27:123-140; Silman & Hochberg, 1993, Rheumatoid Arthritis, *Epidemiology of the Rheumatic Diseases*, Oxford University Press, pp. 7-68) and there is a gradient in Europe with a higher prevalence in the north (Cimmino et al., 1998, *Ann. Rheum. Diseases* 57:315-318). RA can also occur in any age group. Onset is typically between the ages of 40 and 60 years, and the incidence increases with age until approximately 70-80 years, at which point it declines (Abdel-Nasser et al., 1997, *Semin. Arthritis Rheum.* 27: 123-140; Silman & Hochberg, 1993, *Epidemiology of the Rheumatic Diseases*. Oxford University Press. pp. 7-68). RA is two to three times more common in women than men, depending on age (Linos et al., 1980, *J. Chronic Diseases* 33:73-77). The observations that (i) women in the postpartum period are at increased risk for RA onset and (ii) women with RA commonly experience remission during pregnancy followed by postpartum relapse (Barrett et al., 1999, *Arhritis Rheum.* 42:1219-1227) suggest that hormones play a role in disease onset.

RA is a chronic, progressive disease of unknown etiology characterized by the infiltration of activated lymphocytes and macrophages into the synovial lining of the affected joint. These cells produce cytokines and degradative enzymes, which mediate inflammation and destruction of the joint architecture, often leading to permanent disability. RA is a systemic disease; extra-articular manifestations are often present and can range from relatively minor problems, such as rheumatoid nodules, to life-threatening organ disease.

Clinically, RA is a highly heterogeneous disease varying from very mild to severely disabling disease with upwards of one in 20 patients progressing to severe, erosive disease. Joint damage occurs early in disease with the greatest progression to joint abnormalities taking place during the first six years. Within three years of disease onset, as many as 70% of patients show some radiographic evidence of joint damage (Lipsky et al., 1994, Rheumatoid Arthritis, *Harrison's Principles of Internal Medicine*, 13th ed. New York, McGraw-Hill, Inc., pp. 1648-1655). At present, there is no cure for RA, and the joint damage is irreversible.

Although the course of RA is highly variable, most patients with clinical, persistent RA eventually develop debilitating joint damage and deformation, resulting in progressive functional limitation. Consequently, RA is considered a highly disabling disease with a considerable economic impact that some liken to that of coronary artery disease (Allaire et al., 1994, *Pharmacoeconomics* 6:513-522). A 1993 study in the U.S. estimated total annual direct costs of $5275 per patient with indirect costs as high as $21,000 per year (Merkesdal et al., 2001, *Arthritis Rheum.* 44:528-534).

RA is thought to be a complex disease precipitated by the interplay of environmental and genetic factors. Although several environmental triggers have been suggested, such as infection (Harris, 1990, *N. Engl. J. Med.* 322:1277-1289), immunization (Symmons and Chakravarty, 1993, *Ann. Rheum. Dis.* 52:843-844), diet (Shapiro et al., 1996, *Epidemiology* 7:256-263), and smoking (Symmons et al., 1997, *Arthritis Rheum.* 40:1955-1961), none have been established. A genetic component to RA susceptibility has long been indicated by data from twin and family studies. It is estimated that the concordance between monozygotic twins is in the range of 12-15% while the prevalence in siblings of RA probands is approximately 2-4%, both well above the estimated background population prevalence of 0.5-1% (Seldin et al., 1999, *Arthritis Rheum.* 42:1071-1079). From these data, the disease heritability has been estimated at approximately 60% (MacGregor et al., 2000, *Arthritis Rheum.* 43:30-37) while the relative recurrence risk for siblings (Xs) of probands with RA is estimated at between 5 and 10 (Seldin et al. 1999; Jawaheer et al., 2001, *Am. J. Hum. Genet.* 68:927-936).

Among the many genetic studies of small cohorts, the only genes consistently associated with RA to-date are the MHC, i.e. human leukocyte antigen (HLA)-linked genes, on the short arm of human chromosome 6. It has been estimated that approximately one-third to one-half of the total genetic contribution to RA can be attributed to genes within the HLA complex (Deighton et al., 1989, *Clin. Genet.* 36:178-182). This observation has been supported by three recent genome-wide scans using RA-affected sibling pairs (Cornelis et al., 1998, *Proc. Natl. Acad. Sci. USA* 95:10746-10750; Jawaheer et al., 2001, *Am. J. Hum. Genet.* 68: 927-936; MacKay et al., 2002, *Arthritis Rheum.* 46:632-639). The vast majority of HLA studies of RA have focused on a direct role of HLA-DRB1 alleles that encode a common structural element, but recent evidence suggests that the HLA association is more complex and probably involves other loci within this gene complex. Despite over 20 years of research, it is still unclear whether the implicated HLA-DRB1 alleles, are involved in RA susceptibility or severity of disease (Weyand et al., 1998, *Springer Semin. Immunopathol.* 20:5-22; Fries et al., 2002, *Arthritis Rheum.* 46:2320-2329).

The increasing availability of specific therapies that can halt disease progression has magnified the need for accurate early diagnosis of RA (Maini et al., 1999, *Lancet* 354:1932-1939; Lipsky et al., 2000, *N. Engl. J. Med.* 343: 1594-1602; Weinblatt et al., 1999, *N. Engl. J. Med.* 340: 253-259). Unfortunately, classifying an arthritic disorder such as RA is challenging because no etiological agent has been identified and no clinical or laboratory features uniquely define the disease (Sangha, 2000, *Rheumatology* 39 (suppl. 2): 3-12). The most commonly used diagnostic criteria are those adopted by the American College of Rheumatology in 1987 (Arnett et al., 1988, *Arthritis Rheum.* 31: 315-324), which are based on a combination of clinical, laboratory and radiological assessments. A patient is classified as having RA if he or she satisfies at least four of the following seven criteria: (i) morning stiffness lasting at least one hour; (ii) arthritis of three or more joint areas; (iii) arthritis of hand joints; (iv) symmetric arthritis; (v) rheumatoid nodules; (vi) presence of serum rheumatoid factor (RF); and (vii) radiographic changes in hand or wrist joints. Using these criteria, a trained rheumatologist can usually diagnose RA in individuals who have had disease for more than 12 weeks (Harrison et al., 1998, *J. Rheumatol.* 25: 2324-2330). However, these criteria are largely ineffective for patients during early stages of the disease, such as during the first 12 weeks of disease (Green et al., 1999, *Arthritis Rheum.* 42: 2184-2188), during which time irreversible joint damage has already begun, and cannot predict which patients will develop severe erosive disease and therefore benefit from aggressive early disease modifying therapy.

Early initiation of therapy can provide considerable benefit, not only by reducing pain and inflammation but also by reducing or eliminating the loss of function that accompanies persistent RA, especially when therapy is administered prior to the occurrence of irreversible joint damage. Consequently, there is a need for novel diagnostic markers that enable the detection of RA at an early stage, or that enable the identification of individuals who are predisposed to developing RA. While genome-wide linkage scans of affected sibling pairs have revealed multiple linkage peaks (Cornelis et al., 1998, *Proc. Natl. Acad. Sci. USA* 95: 10746-10750; Jawaheer et al., 2001, *Am. J. Hum. Genet.* 68: 927-936; MacKay et al., 2002, *Arthritis Rheum.* 46: 632-639), specific disease-associated genetic markers have not previously been identified.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all polymorphisms in the human genome are SNPs. SNPs are single base positions in DNA at which different alleles, or alternative nucleotides, exist in a population. The SNP position (interchangeably referred to herein as SNP, SNP site, or SNP locus) is usually preceded by and followed by highly conserved sequences of the allele (e.g., sequences that vary in less than 1/100 or 1/1000 members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms", *Am J Hum Genet* 2002 October; 71(4):854-62).

A synonymous codon change, or silent mutation/SNP (terms such as "SNP", "polymorphism", "mutation", "mutant", "variation", and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers", or "di-allelic markers".

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as rheumatoid arthritis, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to rheumatoid arthritis. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16, 3).

SUMMARY OF THE INVENTION

The present invention relates to the identification of novel SNPs, unique combinations of such SNPs, and haplotypes of SNPs that are associated with rheumatoid arthritis and related pathologies. The polymorphisms disclosed herein are directly useful as targets for the design of diagnostic reagents and the development of therapeutic agents for use in the diagnosis and treatment of rheumatoid arthritis and related pathologies.

Since autoimmune diseases share certain similar features that may be due to common genetic factors that are involved in their underlying mechanisms, the SNPs identified herein as being associated with rheumatoid arthritis may also be used as markers for other autoimmune diseases. Such autoimmune diseases include, but are not limited to, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis. Moreover, the genes containing the SNPs identified herein, and the transcripts and proteins encoded by these genes, can be used in the treatment of other autoimmune diseases, in addition to rheumatoid arthritis. For example, the genes and encoded gene products can serve as targets for the development of therapeutic agents (e.g., small molecule compounds, antibodies, antisense/RNAi agents, etc.) or used directly as therapeutic agents (e.g., therapeutic proteins, etc.) for the treatment of not only rheumatoid arthritis, but various other autoimmune diseases as well.

Based on the identification of SNPs associated with rheumatoid arthritis, the present invention also provides methods of detecting these variants as well as the design and preparation of detection reagents needed to accomplish this task. The invention specifically provides novel SNPs in genetic sequences involved in rheumatoid arthritis, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing rheumatoid arthritis based on the presence of a SNP disclosed herein or its encoded product, methods of identifying individuals who are more or less likely to respond to a treatment, methods of screening for compounds useful in the treatment of a disorder associated with a variant gene/protein, compounds identified by these methods, methods of treating disorders mediated by a variant gene/protein, and methods of using the novel SNPs of the present invention for human identification.

In Tables 1-2, the present invention provides gene information, transcript sequences (SEQ ID NOS:1-669), encoded amino acid sequences (SEQ ID NOS:670-1338), genomic sequences (SEQ ID NOS:10,552-10,915), transcript-based context sequences (SEQ ID NOS:1339-10,551) and genomic-based context sequences (SEQ ID NOS:10,916-49,582 and 50,231) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The transcript sequences (SEQ ID NOS:1-669), amino acid sequences (SEQ ID NOS:670-1338), genomic sequences (SEQ ID NOS:10,552-10,915), transcript-based SNP context sequences (SEQ ID NOS: 1339-10,551), and genomic-based SNP context sequences (SEQ ID NOS:10,916-49,582 and 50,231) are also provided in the Sequence Listing.

In a specific embodiment of the present invention, SNPs which occur naturally in the human genome are provided as isolated nucleic acid molecules. These SNPs are associated with rheumatoid arthritis such that they can have a variety of uses in the diagnosis and/or treatment of rheumatoid arthritis. One aspect of the present invention relates to an isolated nucleic acid molecule comprising a nucleotide sequence in which at least one nucleotide is a SNP disclosed in Tables 3 and/or 4. In an alternative embodiment, a nucleic acid of the invention is an amplified polynucleotide, which is produced by amplification of a SNP-containing nucleic acid template. In another embodiment, the invention provides for a variant protein which is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein which is encoded by a nucleic acid molecule containing a SNP disclosed herein. A preferred embodiment of a protein detection reagent is an antibody or an antigen-reactive antibody fragment.

Also provided in the invention are kits comprising SNP detection reagents, and methods for detecting the SNPs disclosed herein by employing detection reagents. In a specific embodiment, the present invention provides for a method of identifying an individual having an increased or decreased risk of developing rheumatoid arthritis by detecting the presence or absence of a SNP allele disclosed herein. In another embodiment, a method for diagnosis of rheumatoid arthritis by detecting the presence or absence of a SNP allele disclosed herein is provided.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of rheumatoid arthritis.

An aspect of this invention is a method for treating rheumatoid arthritis in a human subject wherein said human subject harbors a gene, transcript, and/or encoded protein identified in Tables 1-2, which method comprises administering to said human subject a therapeutically or prophylactically effective amount of one or more agents counteracting the effects of the disease, such as by inhibiting (or stimulating) the activity of the gene, transcript, and/or encoded protein identified in Tables 1-2.

Another aspect of this invention is a method for identifying an agent useful in therapeutically or prophylactically treating rheumatoid arthritis in a human subject wherein said human subject harbors a gene, transcript, and/or encoded protein identified in Tables 1-2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating rheumatoid arthritis in a human subject, which method comprises:

(i) determining that said human subject harbors a gene, transcript, and/or encoded protein identified in Tables 1-2, and (ii) administering to said subject a therapeutically or prophylactically effective amount of one or more agents counteracting the effects of the disease.

Many other uses and advantages of the present invention will be apparent to those skilled in the art upon review of the detailed description of the preferred embodiments herein. Solely for clarity of discussion, the invention is described in the sections below by way of non-limiting examples.

Description of the Files Contained on the CD-R Named CL001505CDR

---

LENGTHY TABLES

The patent contains a lengthy table section. A copy of the table is available in electronic form from the USPTO web site (http://seqdata.uspto.gov/?pageRequest=docDetail&DocID=US07833706B2). An electronic copy of the table will also be available from the USPTO upon request and payment of the fee set forth in 37 CFR 1.19(b)(3).

---

The CD-R named CL001505CDR contains the following five text (ASCII) files:

1) File SEQLIST_1505.txt provides the Sequence Listing. The Sequence Listing provides the transcript sequences (SEQ ID NOS:1-669) and protein sequences (SEQ ID NOS:670-1338) as shown in Table 1, and genomic sequences (SEQ ID NOS:10,552-10,915) as shown in Table 2, for each rheumatoid arthritis-associated gene that contains one or more SNPs of the present invention. Also provided in the Sequence Listing are context sequences flanking each SNP, including both transcript-based context sequences as shown in Table 1 (SEQ ID NOS:1339-10,551) and genomic-based context sequences as shown in Table 2 (SEQ ID NOS:10,916-49,582 and 50,231). The context sequences generally provide 100 bp upstream (5') and 100 bp downstream (3') of each SNP, with the SNP in the middle of the context sequence, for a total of 200 bp of context sequence surrounding each SNP. File SEQLIST_1505.txt is 52,678 KB in size, and was created on Jan. 29, 2004.

2) File TABLE1_1505.txt provides Table 1. File TABLE1_1505.txt is 8,570 KB in size, and was created on Jan. 29, 2004.

3) File TABLE2_1505.txt provides Table 2. File TABLE2_1505.txt is 42,435 KB in size, and was created on Jan. 29, 2004.

4) File TABLE3_1505.txt provides Table 3. File TABLE3_1505.txt is 115 KB in size, and was created on Jan. 29, 2004.

5) File TABLE4_1505.txt provides Table 4. File TABLE4_1505.txt is 120 KB in size, and was created on Jan. 29, 2004.

The material contained on the CD-R labeled CL001505CDR is hereby incorporated by reference pursuant to 37 CFR 1.77(b)(4).

Description of Table 1 and Table 2

Table 1 and Table 2 (both provided on the CD-R) disclose the SNP and associated gene/transcript/protein information of the present invention. For each gene, Table 1 and Table 2 each provide a header containing gene/transcript/protein information, followed by a transcript and protein sequence (in Table 1) or genomic sequence (in Table 2), and then SNP information regarding each SNP found in that gene/transcript.

NOTE: SNPs may be included in both Table 1 and Table 2; Table 1 presents the SNPs relative to their transcript sequences and encoded protein sequences, whereas Table 2 presents the SNPs relative to their genomic sequences (in some instances Table 2 may also include, after the last gene sequence, genomic sequences of one or more intergenic regions, as well as SNP context sequences and other SNP information for any SNPs that lie within these intergenic regions). SNPs can readily be cross-referenced between Tables based on their hCV (or, in some instances, hDV) identification numbers.

The gene/transcript/protein information includes:
- a gene number (1 through n, where n=the total number of genes in the Table)
- a Celera hCG and UID internal identification numbers for the gene
- a Celera hCT and UID internal identification numbers for the transcript (Table 1 only)
- a public Genbank accession number (e.g., RefSeq NM number) for the transcript (Table 1 only)
- a Celera hCP and UID internal identification numbers for the protein encoded by the hCT transcript (Table 1 only)
- a public Genbank accession number (e.g., RefSeq NP number) for the protein (Table 1 only)
- an art-known gene symbol
- an art-known gene/protein name
- Celera genomic axis position (indicating start nucleotide position-stop nucleotide position)
- the chromosome number of the chromosome on which the gene is located
- an OMIM (Online Mendelian Inheritance in Man; Johns Hopkins University/NCBI) public reference number for obtaining further information regarding the medical significance of each gene
- alternative gene/protein name(s) and/or symbol(s) in the OMIM entry NOTE: Due to the presence of alternative splice forms, multiple transcript/protein entries can be provided for a single gene entry in Table 1; i.e., for a single Gene Number, multiple entries may be provided in series that differ in their transcript/protein information and sequences.

Following the gene/transcript/protein information is a transcript sequence and protein sequence (in Table 1), or a genomic sequence (in Table 2), for each gene, as follows:
- transcript sequence (Table 1 only) (corresponding to SEQ ID NOS:1-669 of the Sequence Listing), with SNPs identified by their IUB codes (transcript sequences can include 5' UTR, protein coding, and 3' UTR regions). (NOTE: If there are differences between the nucleotide sequence of the hCT transcript and the corresponding public transcript sequence identified by the Genbank accession number, the hCT transcript sequence (and encoded protein) is provided, unless the public sequence is a RefSeq transcript sequence identified by an NM number, in which case the RefSeq NM transcript sequence (and encoded protein) is provided. However, whether the hCT transcript or RefSeq NM transcript is used as the transcript sequence, the disclosed SNPs are represented by their IUB codes within the transcript.)
- the encoded protein sequence (Table 1 only) (corresponding to SEQ ID NOS:670-1338 of the Sequence Listing)
- the genomic sequence of the gene (Table 2 only), including 6 kb on each side of the gene boundaries (i.e., 6 kb on the 5' side of the gene plus 6 kb on the 3' side of the gene) (corresponding to SEQ ID NOS:10,552-10,915 of the Sequence Listing).

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (and such SNPs are identified as "INTERGENIC" for SNP type).

NOTE: The transcript, protein, and transcript-based SNP context sequences are provided in both Table 1 and in the Sequence Listing. The genomic and genomic-based SNP context sequences are provided in both Table 2 and in the Sequence Listing. SEQ ID NOS are indicated in Table 1 for each transcript sequence (SEQ ID NOS:1-669), protein sequence (SEQ ID NOS:670-1338), and transcript-based SNP context sequence (SEQ ID NOS:1339-10,551), and SEQ ID NOS are indicated in Table 2 for each genomic sequence (SEQ ID NOS:10,552-10,915), and genomic-based SNP context sequence (SEQ ID NOS:10,916-49,582 and 50,231).

The SNP information includes:
- context sequence (taken from the transcript sequence in Table 1, and taken from the genomic sequence in Table 2) with the SNP represented by its IUB code, including 100 by upstream (5') of the SNP position plus 100 by downstream (3') of the SNP position (the transcript-based SNP context sequences in Table 1 are provided in the Sequence Listing as SEQ ID NOS:1339-10,551; the genomic-based SNP context sequences in Table 2 are provided in the Sequence Listing as SEQ ID NOS:10, 916-49,582 and 50,231).
- Celera hCV internal identification number for the SNP (in some instances, an "hDV" number is given instead of an "hCV" number)
- SNP position [position of the SNP within the given transcript sequence (Table 1) or within the given genomic sequence (Table 2)]
- SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP Observed during re-sequencing of nucleic acid samples from individuals who have rheumatoid arthritis or a related pathology, "dbSNP"=SNP observed in the dbSNP public database, "HGBASE"=SNP observed in the HGBASE public database, "HGMD"=SNP observed in the Human Gene Mutation Database (HGMD) public database) (NOTE: multiple "Applera" source entries for a single SNP indicate that the same SNP was covered by multiple overlapping amplification products and the re-sequencing results (e.g., observed allele counts) from each of these amplification products is being provided)

Population/allele/allele count information in the format of [population1(first_allele,count|second_allele,count) population2(first_allele,count|second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["-" in the allele field represents a deletion allele of an insertion/deletion ("indel") polymorphism (in which case the corresponding insertion allele, which may be comprised of one or more nucleotides, is indicated in the allele field on the opposite side of the "|"); "-" in the count field indicates that allele count information is not available].

NOTE: For SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

(NOTE: semicolons separate population/allele/count information corresponding to each indicated SNP source; i.e., if four SNP sources are indicated, such as "Celera", "dbSNP", "HGBASE", and "HGMD", then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information)

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary]

Protein coding information (Table 1 only), where relevant, in the format of [protein SEQ ID NO:#, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3 and Table 4

Tables 3 and 4 (both provided on the CD-R) provide a list of a subset of SNPs from Table 1 (in the case of Table 3) or Table 2 (in the case of Table 4) for which the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other.

These SNPs have not been observed in any of the public databases (dbSNP, HGBASE, and HGMD), and were also not observed during shotgun sequencing and assembly of the Celera human genome sequence (i.e., "Celera" SNP source). Tables 3 and 4 provide the hCV identification number (or hDV identification number for SNPs having "Celera Diagnostics" SNP source) and the SEQ ID NO of the context sequence for each of these SNPs.

Description of Table 5

Table 5 provides sequences (SEQ ID NOS:49,583-50,230) of primers that have been synthesized and used in the laboratory to carry out allele-specific PCR reactions in order to assay the SNPs disclosed in Table 6 during the course of rheumatoid arthritis association studies.

Table 5 provides the following:

the column labeled "hCV" provides an hCV identification number for each SNP site the column labeled "Alleles" designates the two alternative alleles at the SNP site identified by the hCV identification number that are targeted by the allele-specific primers (the allele-specific primers are shown as "Sequence A" and "Sequence B")

the column labeled "Sequence A (allele-specific primer)" provides an allele-specific primer that is specific for the first allele designated in the "Alleles" column the column labeled "Sequence B (allele-specific primer)" provides an allele-specific primer that is specific for the second allele designated in the "Alleles" column the column labeled "Sequence C (common primer)" provides a common primer that is used in conjunction with each of the allele-specific primers (the "Sequence A" primer and the "Sequence B" primer) and which hybridizes at a site away from the SNP position.

All primer sequences are given in the 5' to 3' direction.

Each of the alleles designated in the "Alleles" column matches (or is the reverse complement of, depending on the orientation of the primer relative to the designated allele) the 3' nucleotide of the allele-specific primer that is specific for that allele. Thus, the first allele designated in the "Alleles" column matches (or is the reverse complement of) the 3' nucleotide of the "Sequence A" primer, and the second allele designated in the "Alleles" column matches (or is the reverse complement of) the 3' nucleotide of the "Sequence B" primer.

Description of Table 6

Table 6 provides results of statistical analyses for SNPs disclosed in Tables 1-5 (SNPs can be cross-referenced between tables based on their hCV identification numbers). The statistical results shown in Table 6 provide support for the association of these SNP alleles with rheumatoid arthritis.

NOTE: SNPs can be cross-referenced between Tables 1-6 based on the hCV identification number of each SNP. However, eight of the SNPs disclosed in the tables may possess two different hCV identification numbers, as follows:

hCV11159941 is equivalent to hCV26841917
hCV11690571 is equivalent to hCV26545293
hCV15881845 is equivalent to hCV22274205
hCV15958164 is equivalent to hCV22274459
hCV16094684 is equivalent to hCV22273515
hCV16135142 is equivalent to hCV25474376
hCV2479345 is equivalent to hCV11407883
hCV9283503 is equivalent to hCV26774507

Description of Column Headings for Table 6:

TABLE 6

| Column Heading | Definition |
| --- | --- |
| Marker | hCV identification number of the tested SNP |
| Typed in Discovery and Replication? | "yes" = marker has been genotyped in two independently-derived DNA sample sets (a Discovery Set and a Replication Set); "no" = marker has been genotyped in a single DNA sample set (a Discovery Set only) |
| Study | Sample set used in analysis ("Discovery"; "Replication, All Cases"; or "Replication, Probands") |
| Genotyping | Method of SNP genotyping ("Individual" or "Pool" genotyping) |
| Stratum | The stratum used for the analysis (see the following table for further descriptions) |
| Allele1 | Allele of the SNP for which allele frequencies are given (NOTE: Allele1 may be depicted in Table 6 based on a different orientation, i.e., the reverse complement, relative to how the same allele is depicted in Tables 1-2) |
| Case Freq | Frequency of Allele1 in cases |
| Control Freq | Frequency of Allele1 in controls |
| Allelic p-value | Fisher exact test results for allelic association |
| Odds Ratio | Allelic odds ratio for Allele1 |

Definition of entries in the "Stratum" column of Table 6 for stratification-based analysis:

| Stratum | Definition |
| --- | --- |
| All | All cases and matched controls |
| RF+ | Rheumatoid factor positive cases and matched controls |
| Male | Male cases and matched controls |
| Female | Female cases and matched controls |
| Onset <38 | Cases who had disease onset before the age of 38, and matched controls |
| Onset 38-55 | Cases who had disease onset between the ages of 38 and 55, and matched controls |
| LR-0SE | Cases with no risk shared epitopes at HLA-DRB1 (risk shared epitopes are 1R, 10, 4K, and 4R), and matched controls (controls are matched on age, sex, and grandparental countries of origin, not on HLA-DRB1) |
| LR-1SE | Cases with one low risk shared epitope (1R or 10) at HLA-DRB1, and matched controls (controls are matched on age, sex, and grandparental countries of origin, not on HLA-DRB1) |
| HR-1SE | Cases with one high risk shared epitope (4K or 4R) at HLA-DRB1, and matched controls (controls are matched on age, sex, and grandparental countries of origin, not on HLA-DRB1) |
| HR-2SE | Cases with two risk shared epitopes (1R, 10, 4K, or 4R) at HLA-DRB1, and matched controls (controls are matched on age, sex, and grandparental countries of origin, not on HLA-DRB1) |

DETAILED DESCRIPTION OF THE INVENTION

Figure 1:
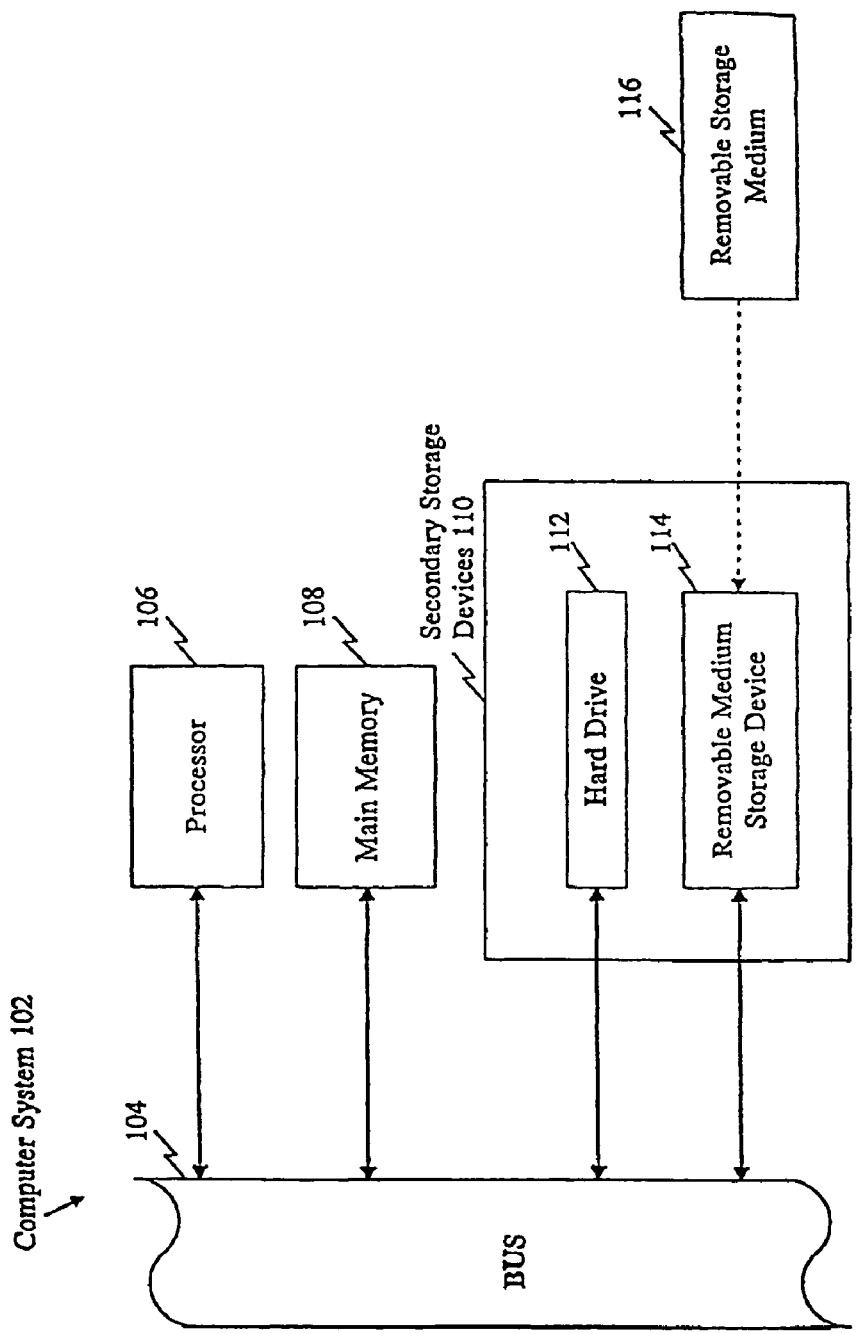
FIG. 1 provides a diagrammatic representation of a computer-based discovery system containing the SNP information of the present invention in computer readable form.

The present invention provides SNPs associated with rheumatoid arthritis, nucleic acid molecules containing SNPs, methods and reagents for the detection of the SNPs disclosed herein, uses of these SNPs for the development of detection reagents, and assays or kits that utilize such reagents. The rheumatoid arthritis-associated SNPs disclosed herein are useful for diagnosing, screening for, and evaluating predisposition to rheumatoid arthritis and related pathologies in humans. Furthermore, such SNPs and their encoded products are useful targets for the development of therapeutic agents.

Since autoimmune diseases share certain similar features that may be due to common genetic factors that are involved in their underlying mechanisms, the SNPs identified herein as being associated with rheumatoid arthritis may also be used as markers for other autoimmune diseases. Such autoimmune diseases include, but are not limited to, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis. Moreover, the genes containing the SNPs identified herein, and, the transcripts and proteins encoded by these genes, can be used in the treatment of other autoimmune diseases, in addition to rheumatoid arthritis. For example, the genes and encoded gene products can serve as targets for the development of therapeutic agents (e.g., small molecule compounds, antibodies, antisense/RNAi agents, etc.) or used directly as therapeutic agents (e.g., therapeutic proteins, etc.) for the treatment of not only rheumatoid arthritis, but various other autoimmune diseases as well.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with rheumatoid arthritis, as well as combinations of SNPs and haplotypes in genetic regions associated with rheumatoid arthritis, polymorphic/variant transcript sequences (SEQ ID NOS:1-669) and genomic sequences (SEQ ID NOS: 10,552-10,915) containing SNPs, encoded amino acid sequences (SEQ ID NOS: 670-1338), and both transcript-based SNP context sequences (SEQ ID NOS: 1339-10,551) and genomic-based SNP context sequences (SEQ ID NOS: 10,916-49,582 and 50,231) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing rheumatoid arthritis, methods of screening for compounds useful for treating disorders associated with a variant gene/protein such as rheumatoid arthritis, compounds identified by these screening methods, methods of using the disclosed SNPs to select a treatment strategy, methods of treating a disorder associated with a variant gene/protein (i.e., therapeutic methods), and methods of using the SNPs of the present invention for human identification.

The present invention provides novel SNPs associated with rheumatoid arthritis, as well as SNPs that were previously known in the art, but were not previously known to be associated with rheumatoid arthritis. Accordingly, the present invention provides novel compositions and methods based on the novel SNPs disclosed herein, and also provides novel methods of using the known, but previously unassociated, SNPs in methods relating to rheumatoid arthritis (e.g., for diagnosing rheumatoid arthritis, etc.). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are indicated in Tables 3-4.

Particular SNP alleles of the present invention can be associated with either an increased risk of having or developing rheumatoid arthritis, or a decreased risk of having or developing rheumatoid arthritis. SNP alleles that are associated with a decreased risk of having or developing rheumatoid arthritis may be referred to as "protective" alleles, and SNP alleles that are associated with an increased risk of having or developing rheumatoid arthritis may be referred to as "susceptibility" alleles or "risk factors". Thus, whereas certain SNPs (or their encoded products) can be assayed to determine whether an individual possesses a SNP allele that is indicative of an increased risk of having or developing rheumatoid arthritis (i.e., a susceptibility allele), other SNPs (or their encoded products) can be assayed to determine whether an individual possesses a SNP allele that is indicative of a decreased risk of having or developing rheumatoid arthritis (i.e., a protective allele). Similarly, particular SNP alleles of the present invention can be associated with either an increased or decreased likelihood of responding to a particular treatment or therapeutic compound, or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type", "reference", or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e. a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide", "peptide", and "protein" are used interchangeably.

Isolated Nucleic Acid Molecules And SNP Detection Reagents & Kits

Tables 1 and 2 provide a variety of information about each SNP of the present invention that is associated with rheumatoid arthritis, including the transcript sequences (SEQ ID NOS:1-669), genomic sequences (SEQ ID NOS:10,552-10, 915), and protein sequences (SEQ ID NOS:670-1338) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:1339-10,551 correspond to transcript-based SNP context sequences disclosed in Table 1, and SEQ ID NOS:10,916-49,582 and 50,231 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Preferred isolated nucleic acid molecules contain one or more SNPs identified in Table 3 and/or Table 4. Isolated nucleic acid molecules containing one or more SNPs disclosed in at least one of Tables 1-4 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are provided in Table 1 and in the Sequence Listing (SEQ ID NOS: 1-669), and polymorphic genomic sequences are provided in Table 2 and in the Sequence Listing (SEQ ID NOS:10,552-10,915). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences provided in Tables 1-2 (transcript sequences are provided in Table 1 as SEQ ID NOS:1-669, genomic sequences are provided in Table 2 as SEQ ID NOS: 10,552-10,915, transcript-based SNP context sequences are provided in Table 1 as SEQ ID NO:1339-10,551, and genomic-based SNP context sequences are provided in Table 2 as SEQ ID NO:10,916-49,582 and 50,231) and their complements. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, N.Y., 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA)

(U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are provided in Table 1 as SEQ ID NOS:1-669, genomic sequences are provided in Table 2 as SEQ ID NOS:10,552-10,915, transcript-based SNP context sequences are provided in Table 1 as SEQ ID NO:1339-10,551, and genomic-based SNP context sequences are provided in Table 2 as SEQ ID NO:10,916-49,582 and 50,231), or any nucleic acid molecule that encodes any of the variant proteins provided in Table 1 (SEQ ID NOS:670-1338). A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences shown in Table 1 and/or Table 2 (transcript sequences are provided in Table 1 as SEQ ID NOS:1-669, genomic sequences are provided in Table 2 as SEQ ID NOS: 10,552-10,915, transcript-based SNP context sequences are provided in Table 1 as SEQ ID NO:1339-10,551, and genomic-based SNP context sequences are provided in Table 2 as SEQ ID NO:10,916-49,582 and 50,231), or any nucleic acid molecule that encodes any of the variant proteins provided in Table 1 (SEQ ID NOS:670-1338). A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are provided in Table 1 as SEQ ID NOS:1-669, genomic sequences are provided in Table 2 as SEQ ID NOS:10,552-10,915, transcript-based SNP context sequences are provided in Table 1 as SEQ ID NO:1339-10, 551, and genomic-based SNP context sequences are provided in Table 2 as SEQ ID NO:10,916-49,582 and 50,231), or any nucleic acid molecule that encodes any of the variant proteins provided in Table 1 (SEQ ID NOS:670-1338). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences shown in Tables 1-2, and can encode a polypeptide that varies to some degree from the specific polypeptide sequences shown in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearsdn, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (provided in Table 1 as SEQ ID NOS:1-669), genomic sequences (provided in Table 2 as SEQ ID NOS:10,552-10,915), and context sequences (transcript-based context sequences are provided in Table 1 as SEQ ID NOS:1339-10,551; genomic-based context sequences are provided in Table 2 as SEQ ID NOS:10,916-49,582 and 50,231), can be used for the design of SNP detection reagents. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs provided in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences provided in Table 1 and/or Table 2 (transcript-based context sequences are provided in Table 1 as SEQ ID NOS:1339-10,551; genomic-based context sequences are Provided in Table 2 as SEQ ID NOS:10,916-49,582 and 50,231). Another example of a detection reagent is a primer which acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-669), genomic sequences (SEQ ID NOS:10,552-10,915), and SNP context sequences (transcript-based context sequences are provided in Table 1 as SEQ ID NOS:1339-10,551; genomic-based context sequences are provided in Table 2 as SEQ ID NOS:10,916-49,582 and 50,231) disclosed in the Sequence Listing and in Tables 1-2. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm which starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides which detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al., *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: Prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes, can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment which is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target. SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays", "microarrays", and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad. Sci.* 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002; 8:85-101; Sosnowski et al., "Active microelectronic array system for DNA hybridization, genotyping and pharmacogenomic applications", *Psychiatr Genet.* 2002 December; 12(4):181-92; Heller, "DNA microarray technology: devices, systems, and applications", *Annu Rev Biomed Eng.* 2002; 4:129-53. Epub 2002 Mar. 22; Kolchinsky et al., "Analysis of SNPs and other genomic variations using gel-based chips", *Hum Mutat.* 2002 April; 19(4):343-60; and McGall et al., "High-density genechip oligonucleotide probe arrays", *Adv Biochem Eng Biotechnol.* 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments; the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5773628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM 6700, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", *Adv Drug Deliv Rev.* 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in the diagnosis and treatment of rheumatoid arthritis. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule provided in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for rheumatoid arthritis or has developed early stage rheumatoid arthritis. Detection of a SNP associated with a disease phenotype provides a diagnostic tool for an active disease and/or genetic predisposition to the disease.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences provided in Table 1. Vectors also include insertion vectors, used to integate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in screening for rheumatoid arthritis or related pathologies, or determining predisposition thereto, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2):43-60; Shi, "Technologies for individual genotyping: detection of genetic polymorphisms in drug targets and disease genes", *Am J Pharmacogenomics.* 2002; 2(3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and 51 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in diagnostic assays for rheumatoid arthritis and related pathologies, and can be readily incorporated into a kit format. The present invention also includes modifications of the Taqman assay well known in the art such as the use of Molecular Beacon probes (U.S. Pat. Nos. 5,118, 801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6054564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application US01/17329 (and 09/584,905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPS) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11): 1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July; 19 Suppl 1:I44-I53; Storm et al., "MALDI-TOF mass spectrometry-based SNP genotyping", *Methods Mol Biol.* 2003; 212:241-62; Jurinke et al., "The use of MassARRAY technology for high throughput genotyping", *Adv Biochem Eng Biotechnol.* 2002; 77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730xl DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (*Genetic Data Analysis*, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $R^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score". In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the p-value of the tests reaches that level. In an exploratory analysis where positive hits will be followed up in subsequent confirmatory testing, an unadjusted p-value <0.1 (a significance level on the lenient side) may be used for generating hypotheses for significant association of a SNP with certain phenotypic characteristics of a disease. It is preferred that a p-value <0.05 (a significance level traditionally used in the art) is achieved in order for a SNP to be considered to have an association with a disease. It is more preferred that a p-value <0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wise error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the susceptibility allele(s).

The SNPs of the invention may contribute to rheumatoid arthritis in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose", "diagnosis", and "diagnostics" include, but are not limited to any of the following: detection of rheumatoid arthritis that an individual may presently have, predisposition screening (i.e., determining the increased risk of an individual in developing rheumatoid arthritis in the future, or determining whether an individual has a decreased risk of developing rheumatoid arthritis in the future), determining a particular type or subclass of rheumatoid arthritis in an individual known to have rheumatoid arthritis, confirming or reinforcing a previously made diagnosis of rheumatoid arthritis, pharmacogenomic evaluation of an individual to determine which therapeutic strategy that individual is most likely to positively respond to or to predict whether a patient is likely to respond to a particular treatment, predicting whether a patient is likely to experience toxic effects from a particular treatment or therapeutic compound, and evaluating the future prognosis of an individual having rheumatoid arthritis. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium". In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

For diagnostic purposes, if a particular SNP site is found to be useful for diagnosing rheumatoid arthritis, then the skilled artisan would recognize that other SNP sites which are in LD with this SNP site would also be useful for diagnosing the condition. Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic applications, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., rheumatoid arthritis) that is influenced by the causative SNP(s). Thus, polymorphic markers that are in LD with causative polymorphisms are useful as diagnostic markers, and are particularly useful when the actual causative polymorphism(s) is/are unknown.

Linkage disequilibrium in the human genome is reviewed in: Wall et al., "Haplotype blocks and linkage disequilibrium in the human genome", *Nat Rev Genet.* 2003 August; 4(8): 587-97; Garner et al., "On selecting markers for association studies: patterns of linkage disequilibrium between two and three diallelic loci", *Genet Epidemiol.* 2003 January; 24(1): 57-67; Ardlie et al., "Patterns of linkage disequilibrium in the human genome", *Nat Rev Genet.* 2002 April; 3(4):299-309 (erratum in *Nat Rev Genet* 2002 July; 3(7):566); and Remm et al., "High-density genotyping and linkage disequilibrium in the human genome using chromosome 22 as a model"; *Curr Opin Chem Biol.* 2002 February; 6(1):24-30.

The contribution or association of particular SNPs and/or SNP haplotypes with disease phenotypes, such as rheumatoid arthritis, enables the SNPs of the present invention to be used to develop superior diagnostic tests capable of identifying individuals who express a detectable trait, such as rheumatoid arthritis, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with rheumatoid arthritis might indicate a probability of 20% that an individual has or is at risk of developing rheumatoid arthritis, whereas detection of five SNPs, each of which correlates with rheumatoid arthritis, might indicate a probability of 80% that an individual has or is at risk of developing rheumatoid arthritis. To further increase the accuracy of diagnosis or predisposition screening, analysis of the SNPs of the present invention can be combined with that of other polymorphism or other risk factors of rheumatoid arthritis, such as disease symptoms, pathological characteristics, family history, diet, environmental factors or lifestyle factors.

It will, of course, be understood by practitioners skilled in the treatment or diagnosis of rheumatoid arthritis that the present invention generally does not intend to provide an absolute identification of individuals who are at risk (or less at risk) of developing rheumatoid arthritis, and/or pathologies related to rheumatoid arthritis, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to rheumatoid arthritis.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, Nature 405, 857-865 (2000); Gould Rothberg, Nature Biotechnology 19, 204-211 (2001); Eichelbaum, Clin. Exp. Pharmacol. Physiol. 23(10-11):983-985 (1996); and Linder, Clin. Chem. 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating rheumatoid arthritis. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms", *Methods Mol Med.* 2003; 85:225-37. Pharmacogenomics as it relates to Alzheimer's disease and other neurodegenerative disorders is discussed in Cacabelos, "Pharmacogenomics for the treatment of dementia", *Ann Med.* 2002; 34(5):357-79, Maimone et al., "Pharmacogenomics of neurodegenerative diseases", *Eur J Pharmacol.* 2001 Feb. 9; 413(1):11-29, and Poirier, "Apolipoprotein E: a pharmacogenetic target for the treatment of Alzheimer's disease", *Mol Diagn.* 1999 December; 4(4):335-41. Pharmacogenomics as it relates to cardiovascular disorders is discussed in Siest et al., "Pharmacogenomics of drugs affecting the cardiovascular system", *Clin Chem Lab Med.* 2003 April; 41(4):590-9, Mukherjee et al., "Pharmacogenomics in cardiovascular diseases", *Prog Cardiovasc Dis.* 2002 May-June; 44(6):479-98, and Mooser et al., "Cardiovascular pharmacogenetics in the SNP era", *J Thromb Haemost.* 2003 July; 1(7):1398-402. Pharmacogenomics as it relates to cancer is discussed in McLeod et al., "Cancer pharmacogenomics: SNPs, chips, and the individual patient", *Cancer Invest.* 2003; 21(4):630-40 and Watters et al., "Cancer pharmacogenomics: current and future applications", *Biochim Biophys Acta.* 2003 Mar. 17; 1603(2):99-111.

The SNPs of the present invention also can be used to identify novel therapeutic targets for rheumatoid arthritis. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Layery et al., "Antisense and RNAi: powerful tools in drug target discovery and validation", *Curr Opin Drug Discov Devel.* 2003 July; 6(4):561-9; Stephens et al., "Antisense oligonucleotide therapy in cancer", *Curr Opin Mol Ther.* 2003 April; 5(2): 118-22; Kurreck, "Antisense technologies. Improvement through novel chemical modifications", *Eur J Biochem.* 2003 April; 270(8):1628-44; Dias et al., "Antisense oligonucleotides: basic concepts and mechanisms", *Mol Cancer Ther.* 2002 March; 1(5):347-55; Chen, "Clinical development of antisense oligonucleotides as anti-cancer therapeutics", *Methods Mol Med.* 2003; 75:621-36; Wang et al., "Antisense anticancer oligonucleotide therapeutics", *Curr Cancer Drug Targets.* 2001 November; 1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as rheumatoid arthritis, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21-22 bp in length) known as small interfering RNAs (siRNAs) which the cell uses in a sequence-specific manner to recognize and destroy complementary RNAs (Thompson, *Drug Discovery Today*, 7 (17): 912-917 (2002)). Thus, because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Agami, "RNAi and related mechanisms and their potential use for therapy", *Curr Opin Chem Biol.* 2002 December; 6(6):829-34; Layery et al., "Antisense and RNAi: powerful tools in drug target discovery and validation", *Curr Opin Drug Discov Devel.* 2003 July; 6(4):561-9; Shi, "Mammalian RNAi for the masses", *Trends Genet* 2003 January; 19(1):9-12), Shuey et al., "RNAi: gene-silencing in therapeutic intervention", *Drug Discovery Today* 2002 October; 7(20):1040-1046; McManus et al., *Nat Rev Genet* 2002 October; 3(10):737-47; Xia et al., *Nat Biotechnol* 2002 October; 20(10):1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as rheumatoid arthritis, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat rheumatoid arthritis. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a rheumatoid arthritis patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as rheumatoid arthritis that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly; if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For example, individuals can be selected for clinical trials based on their SNP genotype. Individuals with SNP genotypes that indicate that they are most likely to respond to the drug can be included in the trials and those individuals whose SNP genotypes indicate that they are less likely to or would not respond to the drug, or suffer adverse reactions, can be eliminated from the clinical trials. This not only improves the safety of clinical trials, but also will enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular rheumatoid arthritis patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine*, 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine*, 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the rheumatoid arthritis-associated proteins, and encoding nucleic acid molecules, disclosed herein can be used as therapeutic targets (or directly used themselves as therapeutic compounds) for treating rheumatoid arthritis and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, 18th ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of a rheumatoid arthritis-associated protein can be administered in combination with another agent that inhibits or stimulates the activity of the same or a different rheumatoid arthritis-associated protein to thereby counteract the affects of rheumatoid arthritis.

For further information regarding pharmacology, see *Current Protocols in Pharmacology*, John Wiley & Sons, Inc., N.Y.

Human Identification Applications

In addition to their diagnostic and therapeutic uses in rheumatoid arthritis and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med*. 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry", *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Mother significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also 'useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, Stanford Technology Law Review and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies, Vectors & Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are provided as SEQ ID NOS:670-1338 in Table 1 and the Sequence Listing. These variants will generally be referred to herein as variant proteins/peptides/polypeptides, or polymorphic proteins/peptides/polypeptides of the present invention. The terms "protein", "peptide", and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons which contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol.* 2003 January; 60(5):523-33. Epub 2002 Nov. 7; Graddis et al., "Designing proteins that work using recombinant technologies", *Curr Pharm Biotechnol.* 2002 December; 3(4):285-97; and Nilsson et al., "Affinity fusion strategies for detection, purification, and immobilization of recombinant proteins", *Protein Expr Punf* 1997 October; 11(1):1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., *Meth. Enzymol.* 182: 626-646 (1990); and Rattan et al., *Ann. N.Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS: 670-1338. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing rheumatoid arthritis or for determining predisposition to rheumatoid arthritis in a human. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with rheumatoid arthritis that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., *Nature* 354:82-84 (1991); Houghten et al., *Nature* 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., *Cell* 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, *Bio/technology*, 1992, Sep. 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as rheumatoid arthritis. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad. Sci. USA,* 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol. Methods* 248:7, 2001), a diabody, a triabody, and a tetrabody (Todorovska et al., *J. Immunol. Methods,* 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature,* 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.,* 169:595, 2002). Fd phage and Fd phagemid technologies may be used to generate and select recombinant antibodies in vitro (Hoogenboom and Chames, *Immunol. Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease", *Expert Rev Vaccines.* 2003 February; 2(1):53-9; Ross et al., "Anticancer antibodies", *Am J Clin Pathol.* 2003 April; 119(4):472-85; Goldenberg, "Advancing role of radiolabeled antibodies in the therapy of cancer", *Cancer Immunol Immunother.* 2003 May; 52(5):281-96. Epub 2003 Mar. 11; Ross et al., "Antibody-based therapeutics in oncology", *Expert Rev Anticancer Ther.* 2003 February; 3(1):107-21; Cao et al., "Bispecific antibody conjugates in therapeutics", *Adv Drug Deliv Rev.* 2003 Feb. 10; 55(2):171-97; von Mehren et al., "Monoclonal antibody therapy for cancer", *Annu Rev Med.* 2003; 54:343-69. Epub 2001 Dec. 3; Hudson et al., "Engineered antibodies", *Nat Med.* 2003 January; 9(1):129-34; Brekke et al., "Therapeutic antibodies for human diseases at the dawn of the twenty-first century", *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems", *Curr Opin Biotechnol.* 2002 December; 13(6):625-9; Andreakos et al., "Monoclonal antibodies in immune and inflammatory diseases", *Curr Opin Biotechnol.* 2002 December; 13(6):615-20; Kellermann et al., "Antibody discovery: the use of transgenic mice to generate human monoclonal antibodies for therapeutics", *Curr Opin Biotechnol.* 2002 December; 13(6):593-7; Pini et al., "Phage display and colony filter screening for high-throughput selection of antibody libraries", *Comb Chem High Throughput Screen.* 2002 November; 5(7):503-10; Batra et al., "Pharmacokinetics and biodistribution of genetically engineered antibodies", Curr Opin Biotechnol. 2002 December; 13(6):603-8; and Tangri et al., "Rationally engineered proteins or antibodies with absent or reduced immunogenicity", Curr Med Chem. 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as rheumatoid arthritis. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly rheumatoid arthritis. Antibodies specific for a variant protein encoded by a SNP-containing nucleic acid molecule of the present invention can be used to assay for the presence of the variant protein, such as to screen for predisposition to rheumatoid arthritis as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., Cytokine 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli, Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kurjan et al., Cell 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. Nature 329:840 (1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251: 1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems", *Curr Opin Biotechnol.* 2002 December; 13(6):625-9; Petters et al., "Transgenic animals as models for human disease", *Transgenic Res.* 2000; 9(4-5):347-51; discussion 345-6; Wolf et al., "Use of transgenic animals in understanding molecular mechanisms of toxicity", *J Pharm Pharmacol.* 1998 June; 50(6):567-74; Echelard, "Recombinant protein production in transgenic animals", *Curr Opin Biotechnol.* 1996 October; 7(5):536-40; Houdebine, "Transgenic animal bioreactors", *Transgenic Res.* 2000; 9(4-5):305-20; Pirity et al., "Embryonic stem cells, creating transgenic animals", *Methods Cell Biol.* 1998; 57:279-93; and Robl et al., "Artificial chromosome vectors and expression of complex proteins in transgenic animals", *Theriogenology.* 2003 Jan. 1; 59(1):107-13.

Computer-Related Embodiments

The SNPs provided in the present invention may be "provided" in a variety of mediums to facilitate use thereof. As used in this section, "provided" refers to a manufacture, other than an isolated nucleic acid molecule, that contains SNP information of the present invention. Such a manufacture provides the SNP information in a form that allows a skilled artisan to examine the manufacture using means not directly applicable to examining the SNPs or a subset thereof as they exist in nature or in purified form. The SNP information that may be provided in such a form includes any of the SNP information provided by the present invention such as, for example, polymorphic nucleic acid and/or amino acid sequence information such as SEQ ID NOS:1-669, SEQ ID NOS:670-1338, SEQ ID NOS:10,552-10,915, SEQ ID NOS: 1339-10,551, and SEQ ID NOS:10,916-49,582 and 50,231; information about observed SNP alleles, alternative codons, populations, allele frequencies, SNP types, and/or affected proteins; or any other information provided by the present invention in Tables 1-2 and/or the Sequence Listing.

In one application of this embodiment, the SNPs of the present invention can be recorded on a computer readable medium. As used herein, "computer readable medium" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has nucleic acid sequences (and encoded protein sequences) containing SNPs provided/recorded thereon in ASCII text format in a Sequence Listing along with accompanying Tables that contain detailed SNP and sequence information (transcript sequences are provided as SEQ ID NOS:1-669, protein sequences are provided as SEQ ID NOS:670-1338, genomic sequences are provided as SEQ ID NOS:10,552-10,915, transcript-based context sequences are provided as SEQ ID NOS: 1339-10,551, and genomic-based context sequences are provided as SEQ ID NOS:10,916-49,582 and 50,231).

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide/amino acid sequence information of the present invention on computer readable medium. For example, the sequence information can be represented in a word processing text file, formatted in commercially-available software such as Word-Perfect and Microsoft Word, represented in the form of an ASCII file, or stored in a database application, such as OB2, Sybase, Oracle, or the like. A skilled artisan can readily adapt any number of data processor structuring formats (e.g., text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et at, *J. Mol. Biol.* 215:403-410 (1990)) and BLAZE (Brutlag et at, *Comp. Chem.* 17:203-207 (1993)) search algorithms.

The present invention further provides systems, particularly computer-based systems, which contain the SNP information described herein. Such systems may be designed to store and/or analyze information on, for example, a large number of SNP positions, or information on SNP genotypes from a large number of individuals. The SNP information of the present invention represents a valuable information source. The SNP information of the present invention stored/analyzed in a computer-based system may be used for such computer-intensive applications as determining or analyzing SNP allele frequencies in a population, mapping disease genes, genotype-phenotype association studies, grouping SNPs into haplotypes, correlating SNP haplotypes with response to particular drugs, or for various other bioinformatic, pharmacogenomic, drug development, or human identification/forensic applications.

As used herein, "a computer-based system" refers to the hardware means, software means, and data storage means used to analyze the SNP information of the present invention. The minimum hardware means of the computer-based systems of the present invention typically comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof, without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs or algorithms that are implemented on the computer-based system to identify or analyze SNPs in a target sequence based on the SNP information stored within the data storage means. Search means can be used to determine which nucleotide is present at a particular SNP position in the target sequence. As used herein, a "target sequence" can be any DNA sequence containing the SNP position(s) to be searched or queried.

As used herein, "a target structural motif," or "target motif," refers to any rationally selected sequence or combination of sequences containing a SNP position in which the sequence(s) is chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. An exemplary format for an output means is a display that depicts the presence or absence of specified nucleotides (alleles) at particular SNP positions of interest. Such presentation can provide a rapid, binary scoring system for many SNPs simultaneously.

One exemplary embodiment of a computer-based system comprising SNP information of the present invention is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

EXAMPLES

Statistical Analysis of Snp Allele Association with Rheumatoid Arthritis

The association of SNP alleles in the human genome with rheumatoid arthritis (RA) was tested using genomic DNA from individuals in two independently collected case-control sample sets, a "Discovery Set" and a "Replication Set".

The Discovery Set consisted of 475 unrelated cases with rheumatoid arthritis and 475 controls (one control matched to each patient on age, sex, and grandparental country of origin). All cases in the Discovery Set met the American College of Rheumatology (ACR) criteria for rheumatoid arthritis and were positive for the autoantibody rheumatoid factor. All subjects who were included had signed informed, written consent and the study protocol was IRB approved.

The Replication Set consisted of 840 cases in 463 families (families consisted of one to six affected siblings), and 926 controls (two controls matched to a single patient, referred to as a proband, from each family on the basis of age, sex, and grandparental country of origin). All cases in the Replication Set met the ACR criteria for rheumatoid arthritis. The Replication Set was considered in two different ways for analysis: as "Replication Set, All Cases," with 840 patients and 926 controls (statistics given are unadjusted for the relatedness of the cases); or as "Replication Set, Probands," using only proband cases, with 463 cases and 926 controls. All subjects who were included had signed informed, written consent and the study protocol was IRB approved.

DNA was extracted from blood samples using standard protocols. Some markers were genotyped individually to generate a specific genotype for every individual. The remaining markers were genotyped on pools of DNA, in which DNA from about 40 individuals was pooled together, and allele frequencies were estimated for the pool. Cases were pooled together on the basis of shared characteristics such as age, gender, and HLA-DRB1 genotype. Controls were pooled based on the pooling of the matched case. Genotypes and pool allele frequencies were measured using a PRISM 7900HT sequence detection PCR system (Applied Biosystems) by allele-specific PCR, similar to the method described by Germer et al (Germer S., Holland M. J., Higuchi R. 2000, Genome Res. 10: 258-266). Primers for the allele-specific PCR reactions are disclosed in Table 5.

Association of a SNP allele with RA was calculated by applying a Fisher exact test to the counts of each allele in cases and controls. The counts of alleles were determined exactly from independent genotyping or estimated from pooled genotyping. Tests of association were carried out using all cases and controls (stratum=All) in several substrata based on characteristics of the cases (e.g., onset <38, male). No correction for multiple testing was made.

Effect sizes were estimated by allelic odds ratios. The reported "Allele1" may be under-represented in cases (with a lower allele frequency in cases than in controls and an odds ratio less than 1, indicating that Allele1 is associated with protection from RA and the other allele is a risk factor for RA) or over-represented in cases (with a higher allele frequency in cases than in controls and an odds ratio greater than 1, indicating that Allele1 is a risk factor in the development of RA).

For markers that have been genotyped in the Discovery Set only, markers listed in Table 6 have a significant p-value of allelic association (less than 0.05) in the All stratum.

For markers that have been genotyped in both the Discovery Set and the Replication Set, markers listed in Table 6 have replicated, significant p-values of allelic association (less than 0.05) in the stratum indicated. Results in the Discovery Set were compared to results in the "Replication Set, All Cases" and in the "Replication Set, Probands". If a marker was significantly associated in the All stratum of the Discovery Set, association in either the All or RF+ strata of the Replication Set was assessed to determine if the association was replicated (as all cases in the Discovery Set were RF+, both comparisons are appropriate). If association of a marker was not replicated in the All or RF+ strata, replicated association was tested within substrata (for example, a marker showing association in the Male stratum of the Discovery Set and the Male stratum of the "Replication Set, Probands" would be considered replicated; conversely, a marker showing association in the Male stratum of the Discovery Set and the Female stratum of the Replication Set would not be sufficient to be considered replicated). Replicated markers are listed in Table 6 only if Allele1 was protective in both sample sets or was a risk factor in both sample sets (markers for which Allele1 was protective in one sample set and a risk factor in another sample set are not listed in Table 6). Replication of a significant association provides further verification that a SNP is associated with RA.

hCV25755336 is an example of a marker that was typed in the Discovery Set only. For hCV25755336, Allele1 (G) is a risk allele (OR>1) that is significantly associated with the development of RA in the All stratum of the Discovery Set.

hCV8367900 is an example of a replicated marker typed in both sample sets. For hCV8367900, Allele1 (T) is a protective allele (OR<1) that is significantly associated with not having RA in the All stratum of the Discovery Set, the "Replication Set, All Cases", and the "Replication Set, Probands". It was also significantly associated with not having RA in the RF+ stratum of the "Replication Set, All Cases" and the "Replication Set, Probands". Because it was replicated in the All stratum (by being significant in the All strata of the Discovery Set and the All or RF+ strata of at least one of the Replication Sets), not all substratum in which it was also replicated are listed.

hCV9505893 is another example of a replicated marker typed in both sample sets. For hCV9505893, Allele1 (G) is a risk allele (OR>1) that is significantly associated with having RA in the All stratum of the Discovery Set and the RF+ stratum of the "Replication Set, All Cases". Because it was replicated in the All/RF+ strata, the substratum in which it was also replicated is not listed.

hCV3191771 is an example of replicated marker in a substratum. For hCV3191771, Allele1 (G) is protective (OR<1) in the Discovery Set and the "Replication Set, Probands" when patients with two risk shared epitopes at HLA-DRB1 are compared to controls matched on age, sex, and grandparental country of origin.

hCV16021387 is an example of a replicated marker typed in both sample sets. For hCV16021387, Allele1 (A) is a risk allele (OR>1) that is significantly associated with having RA in the All stratum of the Discovery Set, the "Replication Set, All Cases", and the "Replication Set, Probands". It was also significantly associated with having RA in the RF+ stratum of the "Replication Set, All Cases" and the "Replication Set, Probands". The Allelic p-value listed for the All stratum of "Replication Set, Probands" is 6.11208E-09, which is standard scientific notation for $6.11208 \times 10^{-9}$ (0.00000000611208).

Although the specific examples described herein are directed towards rheumatoid arthritis, the skilled artisan will appreciate that, since autoimmune diseases share certain similar features that may be due to common genetic factors that are involved in their underlying mechanisms, the SNPs identified herein as being associated with rheumatoid arthritis may also be used as markers for other autoimmune diseases. Such autoimmune diseases include, but are not limited to, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis. Moreover, the genes containing the SNPs identified herein, and the transcripts and proteins encoded by these genes, can be used in the treatment of other autoimmune diseases, in addition to rheumatoid arthritis. For example, the genes and encoded gene products can serve as targets for the development of therapeutic agents (e.g., small molecule compounds, antibodies, antisense/RNAi agents, etc.) or used directly as therapeutic agents (e.g., therapeutic proteins, etc.) for the treatment of not only rheumatoid arthritis, but various other autoimmune diseases as well.

All publications and patents cited in this specification are herein incorporated by reference in their entirety. Various modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 5

| hCV | Alleles | Sequence A (allele-specific primer) | Sequence B (allele-specific primer) |
|---|---|---|---|
| hCV108175 | C/T | ATTGCTTTTGCTACATTGTTG (SEQ ID NO: 49583) | AAATTGCTTTTGCTACATTGTTA (SEQ ID NO: 49584) |
| hCV11159941 | C/T | CCCGTTGGTTCCGAAAG (SEQ ID NO: 49586) | CCCGTTGGTTCCGAAAA (SEQ ID NO: 49587) |
| hCV11195029 | A/G | GGATGGTCTTCTCTTTGTCAA (SEQ ID NO: 49589) | GGATGGTCTTCTCTTTGTCAG (SEQ ID NO: 49590) |
| hCV11276786 | A/T | CATTIGTATTICTTCTGGGGA (SEQ ID NO: 49592) | CATTTGTATTTCTTCTGGGGT (SEQ ID NO: 49593) |
| hCV11297739 | G/T | TCAGCTCATGATGTGTGATG (SEQ ID NO: 49595) | CTCAGCTCATGATGTGTGATT (SEQ ID NO: 49596) |
| hCV11356754 | C/T | GCTTCACATCACATACATCG (SEQ ID NO: 49598) | GGCTTCACATCACATACATCA (SEQ ID NO: 49599) |
| hCV11405566 | A/G | CGGCTCGAGGTTTCAT (SEQ ID NO: 49601) | CGGCTCGAGGMCAC (SEQ ID NO: 49602) |
| hCV11407883 | C/G | CTCCTGAAAGGGTTGAACTC (SEQ ID NO: 49604) | TCCTGAAAGGGTTGAACTG (SEQ ID NO: 49605) |
| hCV11514490 | A/C | ACACATTGGAGAAAGACCTATTT (SEQ ID NO: 49607) | CACATTGGAGAAAGACCTATTG (SEQ ID NO: 49608) |
| hCV11559107 | A/G | TGAGATTTTGAAGACATCTGGTA (SEQ ID NO: 49610) | GAGATTTTGAAGACATCTGGTG (SEQ ID NO: 49611) |
| hCV11597077 | A/C | GAAGTTCTTACCACACTGACTACA (SEQ ID NO: 49613) | GAAGTTCTTACCACACTGACTACC (SEQ ID NO: 49614) |
| hCV11600233 | G/T | GCAGAGCATTGTGTTCG (SEQ ID NO: 49616) | CGCAGAGCATTGTGTTCT (SEQ ID NO: 49617) |
| hCV1166773 | G/C | CCTTTTAGGGTTTTCTGATTATG (SEQ ID NO: 49619) | CCTTTTAGGGTTTTCTGATTATC (SEQ ID NO: 49620) |
| hCV11681250 | A/G | TTTGCAAAGAACTTGATTTCTT (SEQ ID NO: 49622) | TTTGCAAAGAACTTGATTTCTC (SEQ ID NO: 49623) |
| hCV11688904 | A/G | GGCTTCTACCCTCTGGAGA (SEQ ID NO: 49625) | GCTTCTACCCTCTGGAGG (SEQ ID NO: 49626) |
| hCV11690571 | A/G | CATCCAGAGGAAGCATGA (SEQ ID NO: 49628) | ATCCAGAGGAAGCATGG (SEQ ID NO: 49629) |
| hCV11691179 | A/G | GTGTGGCGGAGCAGT (SEQ ID NO: 49631) | TGTGGCGGAGCAGC (SEQ ID NO: 49632) |
| hCV11691237 | G/T | TCACGGTGCTGTCCG (SEQ ID NO: 49634) | CCTCACGGTGCTGTCCT (SEQ ID NO: 49635) |
| hCV11720402 | C/T | TGGGAAATTCAAGGCG (SEQ ID NO: 49637) | CTGGGAAATTCAAGGCA (SEQ ID NO: 49638) |
| hCV11735875 | C/T | TGAGTTTGTATTTTCCAAGGAC (SEQ ID NO: 49640) | ATGAGTTTGTATTTTCCAAGGAT (SEQ ID NO: 49641) |
| hCV11758437 | C/G | TTGTGAAGCCCTAGATTTCC (SEQ ID NO: 49643) | TGTGAAGCCCTAGATTTCG (SEQ ID NO: 49644) |
| hCV11917903 | C/G | AAACTGGTATGTGGGCG (SEQ ID NO: 49646) | AAAACTGGTATGTGGGCC (SEQ ID NO: 49647) |
| hCV11972291 | A/G | TGTTGGCTGAGAGATAAGCTA (SEQ ID NO: 49649) | GTTGGCTGAGAGATAAGCTG (SEQ ID NO: 49650) |
| hCV11972326 | C/G | TTCTTTTAAAGGATTGGTAAACTC (SEQ ID NO: 49652) | TTCTTTTAAAGGATTGGTAAACTG (SEQ ID NO: 49653) |
| hCV11976630 | C/T | AACTGAACGCAGGCCTC (SEQ ID NO: 49655) | AACTGAACGCAGGCCTT (SEQ ID NO: 49656) |
| hCV11976644 | G/T | TGCAGTCATAAATCTCATCAG (SEQ ID NO: 49658) | TTGCAGTCATAAATCTCATCAT (SEQ ID NO: 49659) |
| hCV11976652 | A/G | TGGGTCAGCCCAACAT (SEQ ID NO: 49661) | TGGGTCAGCCCAACAC (SEQ ID NO: 49662) |
| hCV12055895 | C/T | CGCACTTCTCCAGC (SEQ ID NO: 49664) | CCGCACTTCTCCAGT (SEQ ID NO: 49665) |
| hCV12064788 | A/G | TGGGTCAGCCCAACAT (SEQ ID NO: 49667) | TGGGTCAGCCCAACAC (SEQ ID NO: 49668) |
| hCV12074174 | C/G | AATTAGCAACATCATCCTTGG (SEQ ID NO: 49670) | AATTAGCAACATCATCCTTGC (SEQ ID NO: 49671) |
| hCV12074801 | C/T | CACAGTGAATGGTGGGG (SEQ ID NO: 49673) | TCACAGTGAATGGTGGGA (SEQ ID NO: 49674) |
| hCV1231817 | C/T | GCCAACTCCATCCG (SEQ ID NO: 49676) | GGCCAACTCCATCCA (SEQ ID NO: 49677) |
| hCV1248029 | A/G | TACCTGAAACTCTGACGCAT (SEQ ID NO: 49679) | ACCTGAAACTCTGACGCAC (SEQ ID NO: 49680) |
| hCV1253735 | C/T | ACAATGTGAGGATCTTCATG (SEQ ID NO: 49682) | CACAATGTGAGGATCTTCATA (SEQ ID NO: 49683) |
| hCV1283127 | C/G | CAGGCATGACATTGAAAC (SEQ ID NO: 49685) | CAGGCATGACATTGAAAG (SEQ ID NO: 49686) |
| hCV1283131 | C/T | CCCAGGCTAAGAACCTGAC (SEQ ID NO: 49688) | CCCAGGCTAAGAACCTGAT (SEQ ID NO: 49689) |
| hCV1347729 | C/T | TGGAGATGTTCACCTGGTC (SEQ ID NO: 49691) | TGGAGATGTTCACCTGGTT (SEQ ID NO: 49692) |
| hCV1347731 | A/G | AGCTCTTCCTTCTTCATCA (SEQ ID NO: 49694) | GCTCTTCCTTCTTCATCG (SEQ ID NO: 49695) |
| hCV1413258 | A/G | TAGGAGGGTGAAAAGTGGA (SEQ ID NO: 49697) | GGAGGGTGAAAAGTGGG (SEQ ID NO: 49698) |
| hCV1468814 | C/T | ATCTTTGCCAATGATTTTATTAC (SEQ ID NO: 49700) | AATCTTTGCCAATGATTTTATTAT (SEQ ID NO: 49701) |
| hCV1545307 | A/G | CCCCCTTACCTTGGAAGA (SEQ ID NO: 49703) | CCCCTTACCTTGGAAGG (SEQ ID NO: 49704) |
| hCV15760047 | T/G | AGAAACACCTTCTGTGACTGA (SEQ ID NO: 49706) | GAAACACCTTCTGTGACTGC (SEQ ID NO: 49707) |
| hCV15852026 | A/G | CCTTTGCATTCCTTAGCA (SEQ ID NO: 49709) | CCTTTGCATTCCTTAGCG (SEQ ID NO: 49710) |
| hCV15867521 | C/T | CGTGTCCTTCCCAACG (SEQ ID NO: 49712) | TCGTGTCCTTCCCAACA (SEQ ID NO: 49713) |
| hCV15874455 | C/T | GGCTGCGATTCCG (SEQ ID NO: 49715) | GTGGCTGCGATTCCA (SEQ ID NO: 49716) |
| hCV15876778 | C/T | GGCGATATTGGTGAGAAAC (SEQ ID NO: 49718) | GGCGATATTGGTGAGAAAT (SEQ ID NO: 49719) |
| hCV15879463 | C/T | TTTTGTCCCAGTGCTGAG (SEQ ID NO: 49721) | TTTTGTCCCAGTGCTGAA (SEQ ID NO: 49722) |
| hCV15881845 | C/G | ACAAAAGAATGTCCTTTCAGAC (SEQ ID NO: 49724) | ACAAAAGAATGTCCTTTCAGAG (SEQ ID NO: 49725) |
| hCV15888165 | A/T | TGAGAGTTGGATCTGGCAA (SEQ ID NO: 49727) | TGAGAGTTGGATCTGGCAT (SEQ ID NO: 49728) |
| hCV15941749 | C/T | AGGCGGAGACAGC (SEQ ID NO: 49730) | CAAGGCGGAGACAGT (SEQ ID NO: 49731) |
| hCV15958164 | C/G | ACTCCACTGGGAGAGGG (SEQ ID NO: 49733) | ACTCCACTGGGAGAGGC (SEQ ID NO: 49734) |
| hCV15976147 | C/G | CTAGCATTGAACTGAATGAGC (SEQ ID NO: 49736) | CTAGCATTGAACTGAATGAGG (SEQ ID NO: 49737) |
| hCV16006934 | G/A | GGACCTGCTTTGGCG (SEQ ID NO: 49739) | TGGACCTGCTTTGGCA (SEQ ID NO: 49740) |
| hCV16006940 | C/G | CGTCCACCTTCTCCAAG (SEQ ID NO: 49742) | CGTCCACCTTCTCCAAC (SEQ ID NO: 49743) |
| hCV16021387 | A/G | CCTCCACTTCCTGTAT (SEQ ID NO: 49745) | CCTCCACTTCCTGTAC (SEQ ID NO: 49746) |
| hCV16023642 | C/T | TGCCTATGAATTGTCAACATC (SEQ ID NO: 49748) | TGCCTATGAATTGTCAACATT (SEQ ID NO: 49749) |
| hCV16046615 | A/T | TTTAACAGATTCTGGAAGCATAGT (SEQ ID NO: 49751) | TTAACAGATTCTGGAAGCATAGA (SEQ ID NO: 49752) |
| hCV16062492 | A/G | CCTGGGATTTGGGATT (SEQ ID NO: 49754) | CCTGGGATTTGGGATC (SEQ ID NO: 49755) |
| hCV16094684 | G/C | TGTGGCTTCTTTTCAGAGC (SEQ ID NO: 49757) | TGTGGCTTCTTTTCAGAGG (SEQ ID NO: 49758) |
| hCV16135142 | C/G | CTCCTCCTGCAGATCACTC (SEQ ID NO: 49760) | TCCTCCTGCAGATCACTG (SEQ ID NO: 49761) |
| hCV16135464 | C/T | CGACTCCTCCTCAGCCC (SEQ ID NO: 49763) | CGACTCCTCCTCAGCCT (SEQ ID NO: 49764) |
| hCV16142950 | A/G | CAAAGCACTTTCATGTACATTATT (SEQ ID NO: 49766) | CAAAGCACTTTCATGTACATTATC (SEQ ID NO: 49767) |
| hCV16166772 | A/C | CGAGACTTCCTGCTACGTTT (SEQ ID NO: 49769) | CGAGACTTCCTGCTACGTTG (SEQ ID NO: 49770) |
| hCV16194374 | T/C | GAGGATCCTGAACTCCAA (SEQ ID NO: 49772) | GAGGATCCTGAACTCCAG (SEQ ID NO: 49773) |
| hCV16229390 | G/T | CTGGGAAGCTTCTGGAC (SEQ ID NO: 49775) | CTGGGAAGCTTCTGGAA (SEQ ID NO: 49776) |
| hCV163035 | C/T | GGAAGTGACAACACAAAACC (SEQ ID NO: 49778) | CGGAAGTGACAACACAAAACT (SEQ ID NO: 49779) |
| hCV1653105 | C/T | CCTGGAACTTTGATTGTGATAC (SEQ ID NO: 49781) | CCTGGAACTTTGATTGTGATAT (SEQ ID NO: 49782) |
| hCV1654841 | A/C | AAACGCAGGGATTGGTTA (SEQ ID NO: 49784) | AACGCAGGGATTGGTTC (SEQ ID NO: 49785) |
| hCV1671515 | C/T | GGTGAGATAGTCCAGAAAGC (SEQ ID NO: 49787) | GGGTGAGATAGTCCAGAAAGT (SEQ ID NO: 49788) |
| hCV1709713 | A/G | GCCCCATCTTGCTGAT (SEQ ID NO: 49790) | GCCCCATCTTGCTGAC (SEQ ID NO: 49791) |
| hCV1724443 | A/G | CCGCCTCGGTCGTT (SEQ ID NO: 49793) | CCGCCTCGGTCGTC (SEQ ID NO: 49794) |
| hCV1773247 | C/T | CCAGCATAGGTGCAAACC (SEQ ID NO: 49796) | ACCAGCATAGGTGCAAACT (SEQ ID NO: 49797) |

TABLE 5-continued

| | | | |
|---|---|---|---|
| hCV1815793 | G/T | CATTTTTCAACTACCTTTCTGTG (SEQ ID NO: 49799) | TCATTTTTCAACTACCTTTCTGTT (SEQ ID NO: 49800) |
| hCV1839329 | C/G | AGGGITTCTCCCICTGTATGAC (SEQ ID NO: 49802) | AGGGTTTCTCCTCTGTATGAG (SEQ ID NO: 49803) |
| hCV1844607 | C/T | GCTCTCTAGCTGTGATGCC (SEQ ID NO: 49805) | AGCTCTCTAGCTGTGATGCT (SEQ ID NO: 49806) |
| hCV2004708 | A/C | CATTGCTTTCCTAGGTGATAT (SEQ ID NO: 49808) | CATTGCTTTCCTAGGTGATAG (SEQ ID NO: 49809) |
| hCV204710 | A/G | TTTGAGTGTTGCTGGAACA (SEQ ID NO: 49811) | TTGAGTGTTGCTGGAACG (SEQ ID NO: 49812) |
| hCV2083657 | G/T | CTCGGATGGTGTTGGTAC (SEQ ID NO: 49814) | CTCGGATGGTGTTGGTAA (SEQ ID NO: 49815) |
| hCV2095401 | C/G | CTGTACAGCCCCTGAAAG (SEQ ID NO: 49817) | CTGTACAGCCCCTGAAAC (SEQ ID NO: 49818) |
| hCV2104738 | C/T | CAGGCGGAAAACTCTCTG (SEQ ID NO: 49820) | TCAGGCGGAAAACTCTCTA (SEQ ID NO: 49821) |
| hCV2153710 | A/G | GGGTATCACCCTTGGATAAA (SEQ ID NO: 49823) | GGGTATCACCCTTGGATAAG (SEQ ID NO: 49824) |
| hCV216064 | A/G | TTTATTTTTCAGCAACACTTGAT (SEQ ID NO: 49826) | TTTATTTTTCAGCAACACTTGAC (SEQ ID NO: 49827) |
| hCV2190540 | A/G | AAAGTGCTGGGATTATAGTCATA (SEQ ID NO: 49829) | AAGTGCTGGGATTATAGTCATG (SEQ ID NO: 49830) |
| hCV22273515 | C/G | TGTGGCTTCTTTTCAGAGC (SEQ ID NO: 49832) | TGTGGCTTCTTTTCAGAGG (SEQ ID NO: 49833) |
| hCV2250399 | A/C | TGAAAACTCAGTCCAAGTCCTA (SEQ ID NO: 49835) | GAAAACTCAGTCCAAGTCCTC (SEQ ID NO: 49836) |
| hCV2259574 | A/T | AATGTGGACACTGAAGAGACA (SEQ ID NO: 49838) | CAATGTGGACACTGAAGAGACT (SEQ ID NO: 49839) |
| hCV2437234 | G/A | ATGCTGCCTGAGTCACAC (SEQ ID NO: 49841) | ATGCTGCCTGAGTCACAT (SEQ ID NO: 49842) |
| hCV2438216 | A/G | GCCCACTGTCCCCA (SEQ ID NO: 49844) | CCCACTGTCCCCG (SEQ ID NO: 49845) |
| hCV2438322 | C/T | GGTCCTTGAGGGAAACG (SEQ ID NO: 49847) | AGGTCCTTGAGGGAAACA (SEQ ID NO: 49848) |
| hCV2455742 | C/T | GCATCGCATCCAAGATG (SEQ ID NO: 49850) | GAGCATCGCATCCAAGATA (SEQ ID NO: 49851) |
| hCV2479345 | C/G | CTCCTGAAAGGGTTGAACTC (SEQ ID NO: 49853) | TCCTGAAAGGGTTGAACTG (SEQ ID NO: 49854) |
| hCV2495658 | C/T | AACTAAAAATCAGTGAGATGAGTG (SEQ ID NO: 49856) | CAACTAAAAATCAGTGAGATGAGTA (SEQ ID NO: 49857) |
| hCV25472930 | A/C | CACCTGTGACCAGCAGCT (SEQ ID NO: 49859) | CCTGTGACCAGCAGCG (SEQ ID NO: 49860) |
| hCV25472931 | A/C | GGGCAGTAGGCTGACTT (SEQ ID NO: 49862) | GGGCAGTAGGCTGACTG (SEQ ID NO: 49863) |
| hCV25473136 | C/T | ACTGAAAGCATTTTAATGGACTAC (SEQ ID NO: 49865) | ACTGAAAGCATTTTAATGGACTAT (SEQ ID NO: 49866) |
| hCV25474376 | C/G | CTCCTCCTGCAGATCACTC (SEQ ID NO: 49868) | TCCTCCTGCAGATCACTG (SEQ ID NO: 49869) |
| hCV25592530 | C/T | CTGAGACAGCAGAGGC (SEQ ID NO: 49871) | TCTGAGACAGCAGAGGT (SEQ ID NO: 49872) |
| hCV25603489 | C/T | CCTGGACAAGCTCATTCG (SEQ ID NO: 49874) | TCCTGGACAAGCTCATTCA (SEQ ID NO: 49875) |
| hCV25606044 | C/T | GCTGGTTCCTGGGGG (SEQ ID NO: 49877) | GCTGGTTCCTGGGGA (SEQ ID NO: 49878) |
| hCV25606714 | A/G | AACTATAATGATAGCTGCTGTTAGTT (SEQ ID NO: 49880) | AACTATAATGATAGCTGCTGTTAGTC (SEQ ID NO: 49881) |
| hCV25607005 | A/G | AGGCCTGGAAGAACATCT (SEQ ID NO: 49883) | GCCTGGAAGAACATCC (SEQ ID NO: 49884) |
| hCV25608626 | A/G | GCCTCCAGCCGCTA (SEQ ID NO: 49886) | CCTCCAGCCGCTG (SEQ ID NO: 49887) |
| hCV25619242 | A/C | TCCTTTTCAAAGCAACAA (SEQ ID NO: 49889) | TCCTTTTCAAAGCCAACAC (SEQ ID NO: 49890) |
| hCV25627747 | A/T | GGATGCCCCAAGGGT (SEQ ID NO: 49892) | GGATGCCCCAAGGGA (SEQ ID NO: 49893) |
| hCV25627998 | C/T | TCMCAAAAACCACTGCC (SEQ ID NO: 49895) | ACTCTTTCAAAAACCACTGCT (SEQ ID NO: 49896) |
| hCV25630843 | G/T | CAGCCCCACGTGCC (SEQ ID NO: 49898) | CAGCCCCACGTGCA (SEQ ID NO: 49899) |
| hCV25630844 | C/T | CACCCATCTGAAGAGCAC (SEQ ID NO: 49901) | CACCCATCTGAAGAGCAT (SEQ ID NO: 49902) |
| hCV25630845 | A/G | GAAGATGGAGAAATGCAGCT (SEQ ID NO: 49904) | AGATGGAGAAATGCAGCC (SEQ ID NO: 49905) |
| hCV25636098 | A/G | CCCTCCAGGTTGTTACCA (SEQ ID NO: 49907) | CCTCCAGGTTGTTACCG (SEQ ID NO: 49908) |
| hCV25638257 | A/G | TGATCCTTTTTAATCCAGGTT (SEQ ID NO: 49910) | TGATCCTTTTTAATCCAGGTC (SEQ ID NO: 49911) |
| hCV25640226 | G/C | GCGGTCTCCATGCC (SEQ ID NO: 49913) | GCGGTCTCCATGCG (SEQ ID NO: 49914) |
| hCV25641653 | C/G | CTCCCGCTTCTGGAAC (SEQ ID NO: 49916) | CTCCCGCTTCTGGAAG (SEQ ID NO: 49917) |
| hCV25649928 | G/A | AAGACTTTTTCCAGGAATGC (SEQ ID NO: 49919) | GAAGACTTTTTCCAGGAATGT (SEQ ID NO: 49920) |
| hCV25650933 | G/T | GCCGTGAACTCGCAG (SEQ ID NO: 49922) | GCCGTGAACTCGCAT (SEQ ID NO: 49923) |
| hCV25653443 | A/T | CTTCTGGGCTTTAAAAAGACTA (SEQ ID NO: 49925) | TTCTGGGCTTTAAAAAGACTT (SEQ ID NO: 49926) |
| hCV25654189 | C/G | TGGTGAGACTCCAGGGTAG (SEQ ID NO: 49928) | TGGTGAGACTCCAGGGTAC (SEQ ID NO: 49929) |
| hCV25654485 | C/T | CCATGACCTGCTCAACA (SEQ ID NO: 49931) | CCATGACCTGCTCAACG (SEQ ID NO: 49932) |
| hCV25742456 | C/G | GCGTCGCTGTCGAGG (SEQ ID NO: 49934) | GCGTCGCTGTCGAGC (SEQ ID NO: 49935) |
| hCV25744634 | C/T | AGCCTCTCCTGGACCG (SEQ ID NO: 49937) | GAGCCTCTCCTGGACCA (SEQ ID NO: 49938) |
| hCV25745882 | C/A | TCGGGCTTGCACAAAG (SEQ ID NO: 49940) | TCGGGCTTGCACAAAT (SEQ ID NO: 49941) |
| hCV25745992 | G/T | GGGGTTGATGTGGGATC (SEQ ID NO: 49943) | TGGGGTTGATGTGGGATA (SEQ ID NO: 49944) |
| hCV25747046 | A/G | GCTGTGACGCTTGTCAA (SEQ ID NO: 49946) | GCTGTGACGCTTGTCAG (SEQ ID NO: 49947) |
| hCV25747791 | C/G | CACTGCTGAGCCCTGAG (SEQ ID NO: 49949) | CACTGCTGAGCCCTGAC (SEQ ID NO: 49950) |
| hCV25751699 | C/T | TGACTCAACTCCCAAGGG (SEQ ID NO: 49952) | CTGACTCAACTCCCAAGGA (SEQ ID NO: 49953) |
| hCV25755336 | A/G | CAGTGAAGCCTTTATTGTAAGTACT (SEQ ID NO: 49955) | AGTGAAGCCTTTATTGTAAGTACC (SEQ ID NO: 49956) |
| hCV25755889 | G/A | AATATTCTCCCAGCATTGTC (SEQ ID NO: 49958) | AATATTCTCCCAGCATTGTT (SEQ ID NO: 49959) |
| hCV25756622 | C/G | AGCAGCACTGTACCTGTCTG (SEQ ID NO: 49961) | GTAGCAGCACTGTACCTGTCTC (SEQ ID NO: 49962) |
| hCV25759203 | C/T | AGATTCTGGTCCTCTTATTGATAC (SEQ ID NO: 49964) | AGATTCTGGTCCTCTTATTGATAT (SEQ ID NO: 49965) |
| hCV25762283 | G/T | CCCGTCCGCGCAG (SEQ ID NO: 49967) | CCCGTCCGCGCAT (SEQ ID NO: 49968) |
| hCV25768636 | A/G | AGAATTTGGCCACAAAGAGT (SEQ ID NO: 49970) | AAMGGCCACAAAGAGC (SEQ ID NO: 49971) |
| hCV25771405 | A/T | CACAGAGCAGGAAGAGCA (SEQ ID NO: 49973) | TCACAGAGCAGGAAGAGCT (SEQ ID NO: 49974) |
| hCV25922909 | C/T | GACATCACAGGGATGAAGG (SEQ ID NO: 49976) | TGACATCACAGGGATGAAGA (SEQ ID NO: 49977) |
| hCV25924724 | C/T | GCGGCACCACCTGAC (SEQ ID NO: 49979) | GCGGCACCACCTGAT (SEQ ID NO: 49980) |
| hCV25926376 | A/G | GTGGTGGGGGAGCA (SEQ ID NO: 49982) | TGGTGGGGGAGCG (SEQ ID NO: 49983) |
| hCV25930645 | G/A | AGTTTTCCCCTTGATCATAC (SEQ ID NO: 49985) | AGTTTTCCCCTTGATCATAT (SEQ ID NO: 49986) |
| hCV25932834 | A/G | GTGCTTCCACTTTAAATTTCTTAT (SEQ ID NO: 49988) | GTGCTTCCACTTTAAATTTCTTAC (SEQ ID NO: 49989) |
| hCV25933676 | G/T | AGCTCATTCGCCACATAC (SEQ ID NO: 49991) | AGCTCATTCGCCACATAA (SEQ ID NO: 49992) |
| hCV25934391 | A/G | GATGCAGGAAATAAGACAATAATA (SEQ ID NO: 49994) | TGCAGGAAATAAGACAATAATG (SEQ ID NO: 49995) |
| hCV25940434 | A/G | GCTTTGGTCGCACAGTGT (SEQ ID NO: 49997) | CTTTGGTCGCACAGTGC (SEQ ID NO: 49998) |
| hCV25942539 | G/A | GGATCCGACCGTTGAG (SEQ ID NO: 50000) | GGATCCGACCGTTGAA (SEQ ID NO: 50001) |
| hCV25953007 | C/T | CCAGGTCCGAGGATCAAC (SEQ ID NO: 50003) | CCAGGTCCGAGGATCAAT (SEQ ID NO: 50004) |
| hCV25953077 | A/C | TGACCGGCTTGTAGGACT (SEQ ID NO: 50006) | GACCGGCTTGTAGGACG (SEQ ID NO: 50007) |
| hCV25958453 | A/G | AAGTTCCTCTGTTTTGTGTGTT (SEQ ID NO: 50009) | AAGTTCCTCTGTTTTGTGTGTC (SEQ ID NO: 50010) |

TABLE 5-continued

| | | | |
|---|---|---|---|
| hCV25960573 | A/G | TGCTGGAGGAGTCACTTGT (SEQ ID NO: 50012) | GCTGGAGGAGTCACTTGC (SEQ ID NO: 50013) |
| hCV25967527 | T/C | CAGCCAGATGGAAGCATT (SEQ ID NO: 50015) | CAGCCAGATGGAAGCATC (SEQ ID NO: 50016) |
| hCV25972265 | C/A | GAGCCAGTGTAACACACATG (SEQ ID NO: 50018) | GAGCCAGTGTAACACACATT (SEQ ID NO: 50019) |
| hCV25972553 | C/T | GTAGAATAAGATGACCACAATCG (SEQ ID NO: 50021) | CGTAGAATAAGATGACCACAATCA (SEQ ID NO: 50022) |
| hCV25983354 | T/G | CCAGCTTCTAATCCAAAATT (SEQ ID NO: 50024) | CCAGCTTCTAATCCAAAATG (SEQ ID NO: 50025) |
| hCV25984541 | G/A | GGAGGCTGGAACTTCG (SEQ ID NO: 50027) | TGGAGGCTGGAACTTCA (SEQ ID NO: 50028) |
| hCV25992555 | A/G | AACCATCCTGTCCTTCCA (SEQ ID NO: 50030) | ACCATCCTGTCCTTCCG (SEQ ID NO: 50031) |
| hCV25993353 | A/G | TACCAGAGATGATGCCGA (SEQ ID NO: 50033) | CCAGAGATGATGCCGG (SEQ ID NO: 50034) |
| hCV25996731 | C/T | CAACCCCTGTTCCTCTG (SEQ ID NO: 50036) | CCAACCCCTGTTCCTCTA (SEQ ID NO: 50037) |
| hCV2619261 | G/T | CTGAGTTCTGATTTCACACG (SEQ ID NO: 50039) | CCTGAGTTCTGATTTCACACT (SEQ ID NO: 50040) |
| hCV2628820 | A/C | CATCCTCCCAGCTACATGA (SEQ ID NO: 50042) | ATCCTCCCAGCTACATGC (SEQ ID NO: 50043) |
| hCV2744375 | G/T | AAGCTATTTGTGGGTTGTATTTC (SEQ ID NO: 50045) | TTAAGCTATTTGTGGGTTGTATTTA (SEQ ID NO: 50046) |
| hCV2926821 | C/T | CGTCCATCCATTCATCTCAC (SEQ ID NO: 50048) | CGTCCATCCATTCATCTCAT (SEQ ID NO: 50049) |
| hCV2936823 | C/T | GGCGCACTCGTCATTG (SEQ ID NO: 50051) | GGCGCACTCGTCATTA (SEQ ID NO: 50052) |
| hCV2950320 | C/T | TCCTTACCGGCATCG (SEQ ID NO: 50054) | CTCCTTACCGGCATCA (SEQ ID NO: 50055) |
| hCV2978734 | C/G | GGTCACCCTCCAATACAATAAC (SEQ ID NO: 50057) | GGTCACCCTCCAATACAATAAG (SEQ ID NO: 50058) |
| hCV2986466 | A/G | TGCAGGCAGAGGAAGAT (SEQ ID NO: 50060) | TGCAGGCAGAGGAAGAC (SEQ ID NO: 50061) |
| hCV2995653 | A/G | GGGAATTGGACAGTATGTGT (SEQ ID NO: 50063) | GGAATTGGACAGTATGTGC (SEQ ID NO: 50064) |
| hCV3015606 | C/T | GGAGAAAAGAAGTGTGGGAC (SEQ ID NO: 50066) | GGAGAAAAGAAGTGTGGGAT (SEQ ID NO: 50067) |
| hCV3026486 | C/T | GGCTGATGGTCCTGGTG (SEQ ID NO: 50069) | AGGCTGATGGTCCTGGTA (SEQ ID NO: 50070) |
| hCV3052660 | A/G | CACCCTGTGATGGAAAGTAGTA (SEQ ID NO: 50072) | CCCTGTGATGGAAAGTAGTG (SEQ ID NO: 50073) |
| hCV3076433 | C/T | ACTGGAGGGCCACC (SEQ ID NO: 50075) | CACTGGAGGGCCACT (SEQ ID NO: 50076) |
| hCV3151199 | A/G | CGTACGTACCATTTCCCT (SEQ ID NO: 50078) | CGTACGTACCATTTCCCC (SEQ ID NO: 50079) |
| hCV3191771 | A/G | GTTGTCATTGATGTCCAAAAT (SEQ ID NO: 50081) | GTTGTCATTGATGTCCAAAAC (SEQ ID NO: 50082) |
| hCV3226838 | A/G | TGTCCCTTAACTGCTCTCA (SEQ ID NO: 50084) | GTCCCTTAACTGCTCTCG (SEQ ID NO: 50085) |
| hCV3233692 | A/G | GGAAGGGTCCCGTGAA (SEQ ID NO: 50087) | GGAAGGGTCCCGTGAG (SEQ ID NO: 50088) |
| hCV3246662 | C/T | GCCGGCTTCTTCCG (SEQ ID NO: 50090) | CAGCCGGCTTCTTCCA (SEQ ID NO: 50091) |
| hCV3248144 | C/T | ACCATGTAGTTGGAGTGG (SEQ ID NO: 50093) | TCACCATGTAGTTGGAGTGA (SEQ ID NO: 50094) |
| hCV3266627 | C/G | TCTGCCAGTGCTGGTG (SEQ ID NO: 50096) | TTCTGCCAGTGCTGGTC (SEQ ID NO: 50097) |
| hCV3274630 | A/G | TCCTTCACGCAGAGCA (SEQ ID NO: 50099) | CCTTCACGCAGAGCG (SEQ ID NO: 50100) |
| hCV3277068 | C/T | AGATGTTACAACTTGATCAGTCG (SEQ ID NO: 50102) | CAGATGTTACAACTTGATCAGTCA (SEQ ID NO: 50103) |
| hCV3293859 | A/G | GTGGCGGGAGGTGAA (SEQ ID NO: 50105) | GTGGCGGGAGGTGAG (SEQ ID NO: 50106) |
| hCV3293876 | C/T | CAGTCAGATGCCAGAGG (SEQ ID NO: 50108) | CCAGTCAGATGCCAGAGA (SEQ ID NO: 50109) |
| hCV443471 | C/T | TGTGAGTACGGAACTGCTTAC (SEQ ID NO: 50111) | TGTGAGTACGGAACTGCTTAT (SEQ ID NO: 50112) |
| hCV478645 | A/C | GCACCACTTCATCAATTAGGTA (SEQ ID NO: 50114) | GCACCACTTCATCAATTAGGTC (SEQ ID NO: 50115) |
| hCV549404 | A/G | ACCTTGGCTCAGTATACCTACA (SEQ ID NO: 50117) | CCTTGGCTCAGTATACCTACG (SEQ ID NO: 50118) |
| hCV549896 | A/G | AATCAGAACCCATCACAAT (SEQ ID NO: 50120) | AATCAGAACCCATCACAAC (SEQ ID NO: 50121) |
| hCV589914 | C/G | GCGTACAGGAGAAGAAACAC (SEQ ID NO: 50123) | GCGTACAGGAGAAGAAACAG (SEQ ID NO: 50124) |
| hCV652816 | C/T | TGGACGGTGCTCCC (SEQ ID NO: 50126) | CTGGACGGTGCTCCT (SEW() NO: 50127) |
| hCV730311 | C/T | CTGCTGCTCCAGGAATC (SEQ ID NO: 50129) | CTGCTGCTCCAGGAATT (SEQ ID NO: 50130) |
| hCV7454533 | C/T | CCTTTACATCAGGGACACG (SEQ ID NO: 50132) | GCCTTTACATCAGGGACACA (SEQ ID NO: 50133) |
| hCV7461647 | A/G | TGGGTCTGGTGCAGTCTACTA (SEQ ID NO: 50135) | GGGTCTGGTGCAGTCTACTG (SEQ ID NO: 50136) |
| hCV7469249 | C/T | GCCCTTCCTTCCTCATC (SEQ ID NO: 50138) | GCCCTTCCTTCCTCATT (SEQ ID NO: 50139) |
| hCV7499127 | A/G | CTCCAGCCTGTTGGTGA (SEQ ID NO: 50141) | TCCAGCCTGTTGGTGG (SEQ ID NO: 50142) |
| hCV7513726 | C/T | TGGCACAGTTCCTGTGG (SEQ ID NO: 50144) | CTGGCACAGTTCCTGTGA (SEQ ID NO: 50145) |
| hCV7514692 | A/C | GCCCCAACACCAGAGAA (SEQ ID NO: 50147) | GCCCCAACACCAGAGAC (SEQ ID NO: 50148) |
| hCV7586912 | C/T | TCCTACCCAGCTCTGCTC (SEQ ID NO: 50150) | TCCTACCCAGCTCTGCTT (SEQ ID NO: 50151) |
| hCV773663 | A/G | GCCCTCTGCAGATCAT (SEQ ID NO: 50153) | GCCCTCTGCAGATCAC (SEQ ID NO: 50154) |
| hCV7912052 | A/G | GCTGGCCTCCCCTTAT (SEQ ID NO: 50156) | GCTGGCCTCCCCTTAC (SEQ ID NO: 50157) |
| hCV7912061 | G/A | CCCTAGGCACAGCTGG (SEQ ID NO: 50159) | GCCCTAGGCACAGCTGA (SEQ ID NO: 50160) |
| hCV795929 | A/G | CAAATAACTCACATCACACAA (SEQ ID NO: 50162) | CAAATAACTCACATCACACAG (SEQ ID NO: 50163) |
| hCV8301529 | T/C | CACTCCGGTCAGAATTCAA (SEQ ID NO: 50165) | CACTCCGGTCAGAATTCAG (SEQ ID NO: 50166) |
| hCV8303385 | C/T | CCTAAACTGGAAAGTTCTTCG (SEQ ID NO: 50168) | ACCTAAACTGGAAAGTTCTTCA (SEQ ID NO: 50169) |
| hCV8367900 | C/T | GGCAGTTCCTCCCCG (SEQ ID NO: 50171) | GGCAGTTCCTCCCCA (SEQ ID NO: 50172) |
| hCV8714838 | A/G | GCCAGAAGGACAGGT (SEQ ID NO: 50174) | GCCAGAAGGACAGGC (SEQ ID NO: 50175) |
| hCV8719596 | C/T | CTTTGTCCATTTTCATCTTCAG (SEQ ID NO: 50177) | CTTTGTCCATTTTCATCTTCAA (SEQ ID NO: 50178) |
| hCV874079 | A/G | TCTGCTCTGGGAACAAA (SEQ ID NO: 50180) | TCTGCTCTGGGAACAAAG (SEQ ID NO: 50181) |
| hCV8766013 | G/T | GATCCTAGCAGTCACAGTTTG (SEQ ID NO: 50183) | GATCCTAGCAGTCACAGTTTT (SEQ ID NO: 50184) |
| hCV8827110 | A/T | ATAGATTTCATATCCATTGTCGTAT (SEQ ID NO: 50186) | TAGATTTCATATCCATTGTCGTAA (SEQ ID NO: 50187) |
| hCV8844728 | C/G | GGCTGGTTCTTTTTCCTTG (SEQ ID NO: 50189) | GGCTGGTTCTTTTTCCTTC (SEQ ID NO: 50190) |
| hCV8848880 | C/A | CTCCACCTTGCAGTCATAAC (SEQ ID NO: 50192) | TCCACCTTGCAGTCATAAA (SEQ ID NO: 50193) |
| hCV8848884 | A/C | TATGTCAGAGCTCACAGAGACTT (SEQ ID NO: 50195) | TGTCAGAGCTCACAGAGACTG (SEQ ID NO: 50196) |
| hCV8870139 | G/T | CCCCAGGGGAACAC (SEQ ID NO: 50198) | CCCCAGGGGAACAA (SEQ ID NO: 50199) |
| hCV8915168 | A/G | TGCAdCGTTCAGCAAA (SEQ ID NO: 50201) | TGCACGCTTCAGCAAG (SEQ ID NO: 50202) |
| hCV8942480 | A/G | GGCATACCACACCAGACAA (SEQ ID NO: 50204) | GGCATACCACACCAGACAG (SEQ ID NO: 50205) |
| hCV8954669 | A/G | GTGGAAAAATGGCTGAAGA (SEQ ID NO: 50207) | TGGAAAAATGGCTGAAGG (SEQ ID NO: 50208) |
| hCV9142770 | A/C | AGTAGGTGTTCAACAACCTGTT (SEQ ID NO: 50210) | GTAGGTGTTCAACAACCTGTG (SEQ ID NO: 50211) |
| hCV9272397 | A/G | CTTAGGAGAGGCTTGTCTGA (SEQ ID NO: 50213) | TTAGGAGAGGCTTGTCTGG (SEQ ID NO: 50214) |
| hCV9283503 | C/G | AATGACATAAATACATACAAGACACAC (SEQ ID NO: 50216) | AATGACATAAATACATACAAGACACAG (SEQ ID NO: 50217) |
| hCV9484175 | C/T | GAAGAGCCACAAGCCTG (SEQ ID NO: 50219) | GGAAGAGCCACAAGCCTA (SEQ ID NO: 50220) |
| hCV9487784 | A/G | AGGAGCCTCCAGGGAA (SEQ ID NO: 50222) | AGGAGCCTCCAGGGAG (SEQ ID NO: 50223) |
| hCV9505893 | A/G | GCTCTGCAGCTCTTCAGACT (SEQ ID NO: 50225) | CTCTGCAGCTCTTCAGACC (SEQ ID NO: 50226) |
| hCV9692842 | C/T | TGTAATTGCCTGGAGCAC (SEQ ID NO: 50228) | TGTAATTGCCTGGAGCAT (SEQ ID NO: 50229) |

TABLE 5-continued

| hCV | Alleles | Sequence C (common primer) |
|---|---|---|
| hCV108175 | C/T | CTTTCAAAGCAATGTGAGATTC (SEQ ID NO: 49585) |
| hCV11159941 | C/T | TGAATAGCCATTAGAAAAAACTGT (SEQ ID NO: 49588) |
| hCV11195029 | A/G | TTTGATGCCAACCCATATG (SEQ ID NO: 49591) |
| hCV11276786 | A/T | TCCTAAGCCAGCCTATTCTAAA (SEQ ID NO: 49594) |
| hCV11297739 | G/T | CCTGTATGCAGCTTAAGTTGATAA (SEQ ID NO: 49597) |
| hCV11356754 | C/T | TCCAATTCCTGCCTCATG (SEQ ID NO: 49600) |
| hCV11405566 | A/G | ACTGGGCCTGGAGTGTAGT (SEQ ID NO: 49603) |
| hCV11407883 | C/G | CAACTCCTGGGCTGAATG (SEQ ID NO: 49606) |
| hCV11514490 | A/C | GCAAGCGAGAAAACTGTGT (SEQ ID NO: 49609) |
| hCV11559107 | A/G | CTGAATGCAAGCTGATGACT (SEQ ID NO: 49612) |
| hCV11597077 | A/C | AATAACTGTGGGAAAATACTTAACAC (SEQ ID NO: 49615) |
| hCV11600233 | G/T | GGTATCTGCAAGGATGAGAAAC (SEQ ID NO: 49618) |
| hCV1166773 | G/C | CAGACGAGAAACCAGAATGAT (SEQ ID NO: 49621) |
| hCV11681250 | A/G | TCCAGTGCAGCATTTACCTA (SEQ ID NO: 49624) |
| hCV11688904 | A/G | CCACTTCTGGAAGGTTCTGTA (SEQ ID NO: 49627) |
| hCV11690571 | A/G | TTGTGCTGGGAGATCTGAG (SEQ ID NO: 49630) |
| hCV11691179 | A/G | CCCCGGCGACCTATAG (SEQ ID NO: 49633) |
| hCV11691237 | G/T | GCTTTGCCCTGCATTTCT (SEQ ID NO: 49636) |
| hCV11720402 | C/T | TTTAAGTCCTGGGTAAACTAAATAGA (SEQ ID NO: 49639) |
| hCV11735875 | C/T | GCTCCATAGAAAGACAATTTACTG (SEQ ID NO: 49642) |
| hCV11758437 | C/G | TTGGCAAAGGAGAACACAA (SEQ ID NO: 49645) |
| hCV11917903 | C/G | TCCCCCTGACTCCTTACTT (SEQ ID NO: 49648) |
| hCV11972291 | A/G | CGTTGACATGGACTTTGAAGT (SEQ ID NO: 49651) |
| hCV11972326 | C/G | AGAGCAGAACGAGGTTTTATTT (SEQ ID NO: 49654) |
| hCV11976630 | C/T | CATTCTGACCTCAACAACTTCA (SEQ ID NO: 49657) |
| hCV11976644 | G/T | AGCAATGGGCACTCAGTC (SEQ ID NO: 49660) |
| hCV11976652 | A/G | TTGAAGAAGGAATGATCACTCTT (SEQ ID NO: 49663) |
| hCV12055895 | C/T | AGGCCATAAAGAGGCAGTAC (SEQ ID NO: 49666) |
| hCV12064788 | A/G | TTGAAGAAGGAATGATCACTCTT (SEQ ID NO: 49669) |
| hCV12074174 | C/G | GCCAGCTCCATATTGAAGTAAT (SEQ ID NO: 49672) |
| hCV12074801 | C/T | AGCTGGGCTGGGTCTAGT (SEQ ID NO: 49675) |
| hCV1231817 | C/T | CATCCGTCACCTCAGAGATG (SEQ ID NO: 49678) |
| hCV1248029 | A/G | TGTTTCCAGGTTCAAMCA (SEQ ID NO: 49681) |
| hCV1253735 | C/T | CACCCACATTGTGTGCATATA (SEQ ID NO: 49684) |
| hCV1283127 | C/G | CAGAATGTAGTCTCGATTCTTCTTC (SEQ ID NO: 49687) |
| hCV1283131 | C/T | CAAAGTGCTGAGCGTACTTG (SEQ ID NO: 49690) |
| hCV1347729 | C/T | GACAGGTTGTTGACATTTTACAA (SEQ ID NO: 49693) |
| hCV1347731 | A/G | TGAACTCTAGGAATCATTTGAAAAT (SEQ ID NO: 49696) |
| hCV1413258 | A/G | GGCAGCGTGCTCAGAC (SEQ ID NO: 49699) |
| hCV1468814 | C/T | GAATCCAAACGATCCAGATAC (SEQ ID NO: 49702) |
| hCV1545307 | A/G | GGCAGTCGCTGGAGATTAT (SEQ ID NO: 49705) |
| hCV15760047 | T/G | CCCAACATCCTCATCTGTCT (SEQ ID NO: 49708) |
| hCV15852026 | A/G | GCCAGAGGCCAAGATGA (SEQ ID NO: 49711) |
| hCV15867521 | C/T | GGGAGAAGACCCTGGAATTCT (SEQ ID NO: 49714) |
| hCV15874455 | C/T | GCAATGGGCATGATTTCA (SEQ ID NO: 49717) |
| hCV15876778 | C/T | CTCCTTCCTCCCACTGTG (SEQ ID NO: 49720) |
| hCV15879463 | C/T | TCTCCGGCCGCATAC (SEQ ID NO: 49723) |
| hCV15881845 | C/G | TCCTCATTGGAATGGAMAT (SEQ ID NO: 49726) |
| hCV15888165 | A/T | CCCAGGAACCCATATTTAGAA (SEQ ID NO: 49729) |
| hCV15941749 | C/T | GGGCAGCAGGAAAGATCT (SEQ ID NO: 49732) |
| hCV15958164 | C/G | CCACAGCCACATGGTATGT (SEQ ID NO: 49735) |
| hCV15976147 | C/G | CAGCCTGCGATGATGAT (SEQ ID NO: 49738) |
| hCV16006934 | G/A | CCTCGGTGGGTTTTCAAG (SEQ ID NO: 49741) |
| hCV16006940 | C/G | CCAGCGTTAGCATCTCATAC (SEQ ID NO: 49744) |
| hCV16021387 | A/G | CCCATCCCACACTTTATTTTATAC (SEQ ID NO: 49747) |
| hCV16023642 | C/T | ACTTCTGGCCAGCAATAAAT (SEQ ID NO: 49750) |
| hCV16046615 | A/T | AGAGGAATCCAAAGACAAAGTTAT (SEQ ID NO: 49753) |
| hCV16062492 | A/G | TGTGCCGAAGTGAAGAAGTC (SEQ ID NO: 49756) |
| hCV16094684 | G/C | GGTAACAGGCACGGAAGTAT (SEQ ID NO: 49759) |
| hCV16135142 | C/G | CCAAGAAGCCAGCTCATTTA (SEQ ID NO: 49762) |
| hCV16135464 | C/T | TGCAGCCACGCAGAAA (SEQ ID NO: 49765) |
| hCV16142950 | A/G | CCTAAGCCCAGAMCTACTCT (SEQ ID NO: 49768) |
| hCV16166772 | A/C | CCCATTACCTGGCTTAGTATCTG (SEQ ID NO: 49771) |
| hCV16194374 | T/C | CGAGGAAGAGGACTGAATGA (SEQ ID NO: 49774) |
| hCV16229390 | G/T | CTTTAAAGCCTGATTCTTGACAT (SEQ ID NO: 49777) |
| hCV163035 | C/T | CCGCCCAGGATTCTCTA (SEQ ID NO: 49780) |
| hCV1653105 | C/T | TCTCCCGCCTTACTCTGTTA (SEQ ID NO: 49783) |
| hCV1654841 | A/C | CATGTGCCTCTCTTGGTATCT (SEQ ID NO: 49786) |
| hCV1671515 | C/T | GGGCCGAGGTCATCTT (SEQ ID NO: 49789) |
| hCV1709713 | A/G | CCGGGTMTGAGAAGTAGAT (SEQ ID NO: 49792) |
| hCV1724443 | A/G | GCAATCGTGGAAGATCAGATA (SEQ ID NO: 49795) |
| hCV1773247 | C/T | GAGTACTGCCTGTTCCTGATAC (SEQ ID NO: 49798) |
| hCV1815793 | G/T | GGTGAGGTTGATGAAAAGAGA (SEQ ID NO: 49801) |
| hCV1839329 | C/G | GAATGGCCAGTTAAAAGAATCT (SEQ ID NO: 49804) |
| hCV1844607 | C/T | TGAGGAATGGGTTGATGAC (SEQ ID NO: 49807) |
| hCV2004708 | A/C | TTCTTCAGGGAACATTTGTATG (SEQ ID NO: 49810) |
| hCV204710 | A/G | TCGCCTCCCTCACTGAC (SEQ ID NO: 49813) |

TABLE 5-continued

| | | |
|---|---|---|
| hCV2083657 | G/T | TGTGGTACAGCAGTCACTAAGA (SEQ ID NO: 49816) |
| hCV2095401 | C/G | AGCAGTCCTGAGTTCTTTAAGAG (SEQ ID NO: 49819) |
| hCV2104738 | C/T | TCAAACTCTCCTCAGATGTTACAG (SEQ ID NO: 49822) |
| hCV2153710 | A/G | TCCCAGACTGCTTTGTAGATG (SEQ ID NO: 49825) |
| hCV216064 | A/G | GGATGTCCTGACAGAAGAAAG (SEQ ID NO: 49828) |
| hCV2190540 | A/G | CAAATACTCAGCAACCAAAAGTC (SEQ ID NO: 49831) |
| hCV22273515 | C/G | GGTAACAGGCACGGAAGTAT (SEQ ID NO: 49834) |
| hCV2250399 | A/C | CCTTATTGCCCGTTTAACAT (SEQ ID NO: 49837) |
| hCV2259574 | A/T | CATCACAGGGCAGAGTTTTAG (SEQ ID NO: 49840) |
| hCV2437234 | G/A | TGTTCATTCAACAAGTCTTTATTG (SEQ ID NO: 49843) |
| hCV2438216 | A/G | CAGAGCCCCACAGTCTTT (SEQ ID NO: 49846) |
| hCV2438322 | C/T | TCCACCTATCCGCCTCTAG (SEQ ID NO: 49849) |
| hCV2455742 | C/T | CCTGGGAGGCTGATGAC (SEQ ID NO: 49852) |
| hCV2479345 | C/G | CAACTCCTGGGCTGAATG (SEQ ID NO: 49855) |
| hCV2495658 | C/T | CACCTGACTCACTCTTCMACTT (SEQ ID NO: 49858) |
| hCV25472930 | A/C | CAATCTGGAAGGAACATCAAG (SEQ ID NO: 49861) |
| hCV25472931 | A/C | GCCGGAGCTCCTGTTT (SEQ ID NO: 49864) |
| hCV25473136 | C/T | TCGTTTCATTTTCATCATTGTATA (SEQ ID NO: 49867) |
| hCV25474376 | C/G | CCAAGAAGCCAGCTCATTTA (SEQ ID NO: 49870) |
| hCV25592530 | C/T | GCCCAGGCTCTAGACACTAA (SEQ ID NO: 49873) |
| hCV25603489 | C/T | CCTGGGTGGCCACTCTA (SEQ ID NO: 49876) |
| hCV25606044 | C/T | CCCACCATCAACAGGTACTT (SEQ ID NO: 49879) |
| hCV25606714 | A/G | TTCACAACAAAGGCAGAGTAA (SEQ ID NO: 49882) |
| hCV25607005 | A/G | GGGCCTCCTACCTGTCATA (SEQ ID NO: 49885) |
| hCV25608626 | A/G | CGGTCTTTGCTGGTACTGC (SEQ ID NO: 49888) |
| hCV25619242 | A/C | TTTCTAACCATTTTAATACAGGTCATA (SEQ ID NO: 49891) |
| hCV25627747 | A/T | CACTTCAGGTGTGTCAACAATG (SEQ ID NO: 49894) |
| hCV25627998 | C/T | AGGGAAACTGCATTTCTTAATC (SEQ ID NO: 49897) |
| hCV25630843 | G/T | GATGCTGATGGAACAAGTGA (SEQ ID NO: 49900) |
| hCV25630844 | C/T | GGCTTTGGTTGCTTTCTCT (SEQ ID NO: 49903) |
| hCV25630845 | A/G | TGGCTGCCTTGAGTCAG (SEQ ID NO: 49906) |
| hCV25636098 | A/G | AGACTGCAGCAAAACTCTGATA (SEQ ID NO: 49909) |
| hCV25638257 | A/G | TGGGCTCAGCTGAACTCTA (SEQ ID NO: 49912) |
| hCV25640226 | G/C | GCCAGGTCCCATTTGAG (SEQ ID NO: 49915) |
| hCV25641653 | C/G | AATCACGGGATTTTCTTTAGAG (SEQ ID NO: 49918) |
| hCV25649928 | G/A | TTCTTAAAGGGTCATGAAACTTAC (SEQ ID NO: 49921) |
| hCV25650933 | G/T | GGGTGTCACCAGGAAGAG (SEQ ID NO: 49924) |
| hCV25653443 | A/T | AAATGGTCAGGTAATTATGTTATCA (SEQ ID NO: 49927) |
| hCV25654189 | C/G | TCAAAGCCTTGTGACATTCTA (SEQ ID NO: 49930) |
| hCV25654485 | C/T | TTGCTGAGCCTGAACTCTG (SEQ ID NO: 49933) |
| hCV25742456 | C/G | GCTTCCACTCCTTGAGGTATT (SEQ ID NO: 49936) |
| hCV25744634 | C/T | AGATCCAAAGGAGAAACACAA (SEQ ID NO: 49939) |
| hCV25745882 | C/A | GGCGGCCTTTCTGAGT (SEQ ID NO: 49942) |
| hCV25745992 | G/T | AACTCCCCAAAACAAAGATCT (SEQ ID NO: 49945) |
| hCV25747046 | A/G | GATCTGCGCCCTGGAC (SEQ ID NO: 49948) |
| hCV25747791 | C/G | CACGMCGTCTGCTTTTACT (SEQ ID NO: 49951) |
| hCV25751699 | C/T | CGGTTCTGCTGTGAGTGAT (SEQ ID NO: 49954) |
| hCV25755336 | A/G | CAGCGTTGAGTCMCTTTACTT (SEQ ID NO: 49957) |
| hCV25755889 | G/A | GTTTTGGAGTCAGAAGATTGTATTA (SEQ ID NO: 49960) |
| hCV25756622 | C/G | TGGCTTTGCACTTTCACAT (SEQ ID NO: 49963) |
| hCV25759203 | C/T | AAAAAGTTCTTGACAAGTTATTATGAG (SEQ ID NO: 49966) |
| hCV25762283 | G/T | TCCGGCATGTTCATCTCT (SEQ ID NO: 49969) |
| hCV25768636 | A/G | CCCCGCCAGACATCTT (SEQ ID NO: 49972) |
| hCV25771405 | A/T | CAGGAAGAAGTTTCATCTGTGAT (SEQ ID NO: 49975) |
| hCV25922909 | C/T | AAGGATGTGTCTTGAATATGTATGT (SEQ ID NO: 49978) |
| hCV25924724 | C/T | CGGATTTCCTAGCTTCTCAACTA (SEQ ID NO: 49981) |
| hCV25926376 | A/G | GCAGCCTAGGGTGAACAT (SEQ ID NO: 49984) |
| hCV25930645 | G/A | CTGTTTGGGACCAAGAATTC (SEQ ID NO: 49987) |
| hCV25932834 | A/G | GCCAATGTCACATTCACTGTA (SEQ ID NO: 49990) |
| hCV25933676 | G/T | GTTTTCCTTGTTTCAGATTTAGTG (SEQ ID NO: 49993) |
| hCV25934391 | A/G | AGAAAGTCCAATAAAAATCTGAACT (SEQ ID NO: 49996) |
| hCV25940434 | A/G | CACAAATGGAAAGGTAAATGAC (SEQ ID NO: 49999) |
| hCV25942539 | G/A | TCATTTTGAACTCATTTTTTCTAGA (SEQ ID NO: 50002) |
| hCV25953007 | C/T | CAAGCCCTCATTTCACCA (SEQ ID NO: 50005) |
| hCV25953077 | A/C | CCTTATCACCCCTTTCTCAG (SEQ ID NO: 50008) |
| hCV25958453 | A/G | CCTCAAATGCCTACCTGATAAT (SEQ ID NO: 50011) |
| hCV25960573 | A/G | GCAAAATGCCCTTCAATG (SEQ ID NO: 50014) |
| hCV25967527 | T/C | ACCAAGTCAGAGAATGACATAGAT (SEQ ID NO: 50017) |
| hCV25972265 | C/A | GAGACTCTGGCATGCTAACTC (SEQ ID NO: 50020) |
| hCV25972553 | C/T | TGTTTCACTGGTGATTCTTCTACT (SEQ ID NO: 50023) |
| hCV25983354 | T/G | TTCAATGGCTTCAGCAACTAT (SEQ ID NO: 50026) |
| hCV25984541 | G/A | CCTCAATACCCTGTCTTAGATTGT (SEQ ID NO: 50029) |
| hCV25992555 | A/G | CCCCCCATTCCTCAAG (SEQ ID NO: 50032) |
| hCV25993353 | A/G | CCCCTCGCCACAGTC (SEQ ID NO: 50035) |
| hCV25996731 | C/T | GTGAGCAGGGAGAGAATCTC (SEQ ID NO: 50038) |
| hCV2619261 | G/T | AAGCTGGGTGGACTTTAGATAC (SEQ ID NO: 50041) |
| hCV2628820 | A/C | GGACCTCCTGCCACTTG (SEQ ID NO: 50044) |
| hCV2744375 | G/T | CTGAGATGGAAATCAACAGAATATA (SEQ ID NO: 50047) |
| hCV2926821 | C/T | CACCATCCCCACACAACT (SEQ ID NO: 50050) |

TABLE 5-continued

| | | |
|---|---|---|
| hCV2936823 | C/T | CACCAGCGGGAAGTCTT (SEQ ID NO: 50053) |
| hCV2950320 | C/T | CACAGAGGCTGAACTTTGTAAAC (SEQ ID NO: 50056) |
| hCV2978734 | C/G | TGACTTGCAATGGAAAGAGAC (SEQ ID NO: 50059) |
| hCV2986466 | A/G | TGCCTTTCAGATCCITTCTACT (SEQ ID NO: 50062) |
| hCV2995653 | A/G | CCTACCCTCATTGTGTGACA (SEQ ID NO: 50065) |
| hCV3015606 | C/T | TCTTTGGGCAGAGATTCTGT (SEQ ID NO: 50068) |
| hCV3026486 | C/T | GCTAAAACAGCAAAATGTGTCTT (SEQ ID NO: 50071) |
| hCV3052660 | A/G | TGGTGATGGTGACTGTGACT (SEQ ID NO: 50074) |
| hCV3076433 | C/T | TGGGTAACTGCATTGACAAA (SEQ ID NO: 50077) |
| hCV3151199 | A/G | CAGGCATCCCTGAAGAACTA (SEQ ID NO: 50080) |
| hCV3191771 | A/G | GGAGCTGGTGCTAGACAAAC (SEQ ID NO: 50083) |
| hCV3226838 | A/G | GGGAGCAGTTTGAACTTCTG (SEQ ID NO: 50086) |
| hCV3233692 | A/G | TGACCCCTTTGTTGTGAGTC (SEQ ID NO: 50089) |
| hCV3246662 | C/T | GCACGGCCTTTGAGTATCTT (SEQ ID NO: 50092) |
| hCV3248144 | C/T | CGTGACCCAGCTATTCATT (SEQ ID NO: 50095) |
| hCV3266627 | C/G | GGCCTCGGTGATCAACTT (SEQ ID NO: 50098) |
| hCV3274630 | A/G | AGGCAGAAAGCTTTCTTGAG (SEQ ID NO: 50101) |
| hCV3277068 | C/T | CGGCAGGATGGTTCTGTA (SEQ ID NO: 50104) |
| hCV3293859 | A/G | TGACTCACCCACATGACAGT (SEQ ID NO: 50107) |
| hCV3293876 | C/T | CCATGGCCACGGATTAC (SEQ ID NO: 50110) |
| hCV443471 | C/T | TGTGTGCCCTTCTTAAGTGTA (SEQ ID NO: 50113) |
| hCV478645 | A/C | GGGATGCCTAATCACTCTATCT (SEQ ID NO: 50116) |
| hCV549404 | A/G | CCAGCACATTAAAATTGATGAT (SEQ ID NO: 50119) |
| hCV549896 | A/G | GCCGGATGAAGCAATAGA (SEQ ID NO: 50122) |
| hCV589914 | C/G | GTTCTTCCCAGCCTGAGATA (SEQ ID NO: 50125) |
| hCV652816 | C/T | GGGAAGCCGTAGGAACAA (SEQ ID NO: 50128) |
| hCV730311 | C/T | AGCCATCCTGATTCTCTGAG (SEQ ID NO: 50131) |
| hCV7454533 | C/T | CGACTTACCAGTTTCATTCTGTATC (SEQ ID NO: 50134) |
| hCV7461647 | A/G | CCTTGTCTTGGAATTCAAACTATG (SEQ ID NO: 50137) |
| hCV7469249 | C/T | AGGCTCTCCATTTTCTTTGTAG (SEQ ID NO: 50140) |
| hCV7499127 | A/G | GAACAGCACTGAAATCCTTTCT (SEQ ID NO: 50143) |
| hCV7513726 | C/T | TTAAAGGCAGTCTCTCTGTCACT (SEQ ID NO: 50146) |
| hCV7514692 | A/C | CCACCACCACTCACCAGA (SEQ ID NO: 50149) |
| hCV7586912 | C/T | GGATGACGCCTCGTAGTCT (SEQ ID NO: 50152) |
| hCV773663 | A/G | TTCCACCTCGTAGGTTGTCT (SEQ ID NO: 50155) |
| hCV7912052 | A/G | CGCCGAGAAGGCATACA (SEQ ID NO: 50158) |
| hCV7912061 | G/A | GCCTGGAACTTTGAGAAGTT (SEQ ID NO: 50161) |
| hCV795929 | A/G | CCAGACACAGGTAGGTAAGA (SEQ ID NO: 50164) |
| hCV8301529 | T/C | CAGCTGCTAAAAGGATTTCTGT (SEQ ID NO: 50167) |
| hCV8303385 | C/T | CTCTCCCTGTGGTTCATTTC (SEQ ID NO: 50170) |
| hCV8367900 | C/T | CAGCTCCTGCTCAGCTAG (SEQ ID NO: 50173) |
| hCV8714838 | A/G | GGAGTTGGACCACTTCTTCA (SEQ ID NO: 50176) |
| hCV8719596 | C/T | TTTTATTAGGTGGATACTTAATACTGAT (SEQ ID NO: 50179) |
| hCV874079 | A/G | GCCTCCCGCATCATC (SEQ ID NO: 50182) |
| hCV8766013 | G/T | TCTCCAATGGCCAAAAATAC (SEQ ID NO: 50185) |
| hCV8827110 | A/T | AAATGGTGGGTTTGAACCTA (SEQ ID NO: 50188) |
| hCV8844728 | C/G | GCAGGTCTCTGAACAGCTCTATA (SEQ ID NO: 50191) |
| hCV8848880 | C/A | TGGGCACTCAGTCACAGA (SEQ ID NO: 50194) |
| hCV8848884 | A/C | TTTCAGGATGGGATTCACA (SEQ ID NO: 50197) |
| hCV8870139 | G/T | CCCAGTGGCTCAACAACTT (SEQ ID NO: 50200) |
| hCV8915168 | A/G | GCCGGCTGTTTCTCTAGG (SEQ ID NO: 50203) |
| hCV8942480 | A/G | AATAAATCACTGGATTTGTTTAGTTAG (SEQ ID NO: 50206) |
| hCV8954669 | A/G | TCAGGGCTCCTACACTTTAGAT (SEQ ID NO: 50209) |
| hCV9142770 | A/C | AAAGAGCATCAATTGGAAAAC (SEQ ID NO: 50212) |
| hCV9272397 | A/G | TTGGCACAGTGAGGATAATC (SEQ ID NO: 50215) |
| hCV9283503 | C/G | TTCCTGATGGGACAGAAATATA (SEQ ID NO: 50218) |
| hCV9484175 | C/T | GAGAGGCACTTTTGGTATTCA (SEQ ID NO: 50221) |
| hCV9487784 | A/G | CAAGCAAGGAAATCAGTAACTTC (SEQ ID NO: 50224) |
| hCV9505893 | A/G | CCTGTTGCCACAGTGAGAA (SEQ ID NO: 50227) |
| hCV9692842 | C/T | GGAAATAAGCATCAGGAACTAACTA (SEQ ID NO: 50230) |

TABLE 6

| Marker | Typed in Discovery and Replication? | Study | Genotyping Stratum | Allele 1 | Case Freq | Control Freq | Allelic p-value | Odds Ratio |
|---|---|---|---|---|---|---|---|---|
| hCV25603489 | yes | Discovery | Pool | All | T | 3.50% | 1.90% | 0.045879259 | 1.88 |
| hCV25603489 | yes | Replication, Probands | Pool | All | T | 4.08% | 2.38% | 0.015767416 | 1.74 |
| hCV25603489 | yes | Replication, Probands | Pool | RF+ | T | 4.44% | 2.45% | 0.015226013 | 1.85 |
| hCV2190540 | yes | Discovery | Pool | Male | G | 39.81% | 48.31% | 0.032038947 | 0.71 |
| hCV2190540 | yes | Replication, All Cases | Pool | Male | G | 38.84% | 51.43% | 0.001493275 | 0.60 |
| hCV2190540 | yes | Replication, Probands | Pool | Male | G | 40.00% | 51.43% | 0.019922507 | 0.63 |
| hCV25472931 | yes | Discovery | Pool | LR-1SE | C | 16.93% | 37.90% | 0.023279092 | 0.33 |
| hCV25472931 | yes | Replication, Probands | Pool | LR-1SE | C | 20.62% | 37.94% | 0.037346491 | 0.42 |
| hCV25940434 | yes | Discovery | Pool | All | G | 0.81% | 2.16% | 0.023139332 | 0.37 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV25940434 | yes | Replication, All Cases | Pool | All | G | 0.40% | 1.12% | 0.021181706 | 0.36 |
| hCV25940434 | yes | Replication, Probands | Pool | All | G | 0.33% | 1.13% | 0.029546939 | 0.29 |
| hCV25940434 | yes | Replication, Probands | Pool | RF+ | G | 0.29% | 1.08% | 0.0471926 | 0.27 |
| hCV8367900 | yes | Discovery | Pool | All | T | 66.19% | 70.95% | 0.029619811 | 0.80 |
| hCV8367900 | yes | Replication, All Cases | Pool | All | T | 64.26% | 68.12% | 0.016922593 | 0.84 |
| hCV8367900 | yes | Replication, Probands | Pool | All | T | 63.69% | 68.05% | 0.025163725 | 0.82 |
| hCV8367900 | yes | Replication, All Cases | Pool | RF+ | T | 63.25% | 68.00% | 0.009428834 | 0.81 |
| hCV8367900 | yes | Replication, Probands | Pool | RF+ | T | 63.27% | 68.00% | 0.024895419 | 0.81 |
| hCV874079 | yes | Discovery | Pool | All | A | 15.98% | 11.30% | 0.002630751 | 1.49 |
| hCV874079 | yes | Replication, All Cases | Individual | All | A | 16.63% | 14.15% | 0.044029734 | 1.21 |
| hCV25762283 | yes | Discovery | Pool | All | G | 17.64% | 86.27% | 0.019475979 | 1.35 |
| hCV25762283 | yes | Replication, Probands | Individual | All | G | 20.82% | 17.67% | 0.049108027 | 1.23 |
| hCV16021387 | yes | Discovery | Individual | All | A | 13.79% | 8.84% | 0.000659444 | 1.65 |
| hCV16021387 | yes | Replication, All Cases | Individual | All | A | 16.85% | 8.32% | 1.48936E-14 | 2.23 |
| hCV16021387 | yes | Replication, Probands | Individual | All | A | 15.77% | 8.32% | 6.11208E-09 | 2.06 |
| hCV16021387 | yes | Replication, All Cases | Individual | RF+ | A | 17.60% | 7.92% | 3.45944E-15 | 2.48 |
| hCV16021387 | yes | Replication, Probands | Individual | RF+ | A | 16.49% | 7.92% | 1.48939E-09 | 2.30 |
| hCV108175 | yes | Discovery | Pool | All | T | 15.85% | 19.78% | 0.026791875 | 0.76 |
| hCV108175 | yes | Replication, All Cases | Pool | All | T | 17.58% | 20.48% | 0.028829558 | 0.83 |
| hCV108175 | yes | Replication, Probands | Pool | All | T | 16.31% | 20.55% | 0.007259321 | 0.75 |
| hCV108175 | yes | Replication, All Cases | Pool | RF+ | T | 16.60% | 20.61% | 0.007705207 | 0.77 |
| hCV108175 | yes | Replication, Probands | Pool | RF+ | T | 16.00% | 20.61% | 0.008210488 | 0.73 |
| hCV1844607 | yes | Discovery | Pool | All | T | 12.19% | 15.57% | 0.039622016 | 0.75 |
| hCV1844607 | yes | Replication, All Cases | Pool | All | T | 12.80% | 15.87% | 0.009586655 | 0.78 |
| hCV1844607 | yes | Replication, Probands | Pool | All | T | 12.65% | 16.02% | 0.022379837 | 0.76 |
| hCV1844607 | yes | Replication, All Cases | Pool | RF+ | T | 13.12% | 16.23% | 0.021858619 | 0.78 |
| hCV1844607 | yes | Replication, Probands | Pool | RF+ | T | 12.20% | 16.23% | 0.010963771 | 0.72 |
| hCV25638257 | yes | Discovery | Pool | Female | G | 16.64% | 23.28% | 0.003019705 | 0.66 |
| hCV25638257 | yes | Replication, Probands | Pool | Female | G | 20.99% | 25.12% | 0.027378014 | 0.79 |
| hCV3151199 | yes | Discovery | Pool | HR-1SE | G | 69.05% | 43.12% | 1.94576E-05 | 2.94 |
| hCV3151199 | yes | Replication, Probands | Pool | HR-1SE | G | 72.71% | 56.60% | 1.30068E-05 | 2.04 |
| hCV25649928 | yes | Discovery | Pool | All | A | 98.45% | 99.45% | 0.040341979 | 0.35 |
| hCV25649928 | yes | Replication, All Cases | Pool | All | A | 99.08% | 99.65% | 0.045951802 | 0.38 |
| hCV25649928 | yes | Replication, Probands | Pool | All | A | 98.88% | 99.65% | 0.017173535 | 0.31 |
| hCV3026486 | yes | Discovery | Pool | LR-1SE | T | 37.64% | 59.54% | 0.030436382 | 0.41 |
| hCV3026486 | yes | Replication, Probands | Pool | LR-1SE | T | 26.60% | 42.42% | 0.044741533 | 0.49 |
| hCV1653105 | yes | Discovery | Individual | All | C | 29.01% | 34.85% | 0.007506913 | 0.76 |
| hCV1653105 | yes | Replication, All Cases | Individual | All | C | 30.24% | 35.34% | 0.001405826 | 0.79 |
| hCV1653105 | yes | Replication, Probands | Individual | All | C | 30.78% | 35.34% | 0.017185142 | 0.81 |
| hCV1653105 | yes | Replication, Probands | Individual | RF+ | C | 30.62% | 34.40% | 0.031838297 | 0.84 |
| hCV11405566 | yes | Discovery | Individual | All | A | 26.60% | 30.93% | 0.041544028 | 0.81 |
| hCV11405566 | yes | Replication, All Cases | Individual | All | A | 27.12% | 30.67% | 0.021269677 | 0.84 |
| hCV11405566 | yes | Replication, Probands | Individual | All | A | 26.95% | 30.67% | 0.046707226 | 0.83 |
| hCV22273515 | yes | Discovery | Individual | All | G | 23.23% | 28.18% | 0.015154923 | 0.77 |
| hCV22273515 | yes | Replication, All Cases | Individual | All | G | 23.51% | 28.40% | 0.000960474 | 0.77 |
| hCV22273515 | yes | Replication, Probands | Individual | All | G | 23.22% | 28.40% | 0.003585905 | 0.76 |
| hCV16094684 | yes | Discovery | Pool | All | C | 22.75% | 28.31% | 0.006184042 | 0.75 |
| hCV16094684 | yes | Replication, All Cases | Pool | All | C | 24.19% | 29.53% | 0.000357769 | 0.76 |
| hCV16094684 | yes | Replication, Probands | Pool | All | C | 23.45% | 29.39% | 0.000892585 | 0.74 |
| hCV16094684 | yes | Replication, Probands | Pool | RF+ | C | 24.00% | 28.59% | 0.022259259 | 0.79 |
| hCV1347729 | yes | Discovery | Individual | All | T | 28.95% | 34.43% | 0.011474103 | 0.78 |
| hCV1347729 | yes | Replication, All Cases | Individual | All | T | 30.30% | 35.15% | 0.002292028 | 0.80 |
| hCV1347729 | yes | Replication, Probands | Individual | All | T | 30.89% | 35.15% | 0.026846383 | 0.82 |
| hCV1347729 | yes | Replication, All Cases | Individual | RF+ | T | 30.70% | 34.22% | 0.046776388 | 0.85 |
| hCV1347731 | yes | Discovery | Individual | All | A | 29.01% | 34.26% | 0.01486531 | 0.78 |
| hCV1347731 | yes | Replication, All Cases | Individual | All | A | 30.15% | 35.19% | 0.001575757 | 0.80 |
| hCV1347731 | yes | Replication, Probands | Individual | All | A | 30.63% | 35.19% | 0.017010922 | 0.81 |
| hCV1347731 | yes | Replication, All Cases | Individual | RF+ | A | 30.52% | 34.27% | 0.034841951 | 0.84 |
| hCV15879463 | yes | Discovery | Individual | All | T | 23.18% | 28.19% | 0.014916897 | 0.77 |
| hCV15879463 | yes | Replication, All Cases | Individual | All | T | 23.36% | 28.36% | 0.000812578 | 0.77 |
| hCV15879463 | yes | Replication, Probands | Individual | All | T | 23.22% | 28.36% | 0.004088083 | 0.76 |
| hCV12074174 | yes | Discovery | Pool | Female | G | 68.38% | 60.83% | 0.006622018 | 1.39 |
| hCV12074174 | yes | Replication, All Cases | Pool | Female | G | 68.73% | 64.79% | 0.032425238 | 1.19 |
| hCV1166773 | yes | Discovery | Pool | All | C | 88.02% | 82.68% | 0.001163769 | 1.54 |
| hCV1166773 | yes | Replication, Probands | Individual | RF+ | C | 87.01% | 83.88% | 0.0484668 | 1.29 |
| hCV9505893 | yes | Discovery | Pool | All | G | 18.55% | 14.10% | 0.010827786 | 1.39 |
| hCV9505893 | yes | Replication, All Cases | Individual | RF+ | G | 17.09% | 14.34% | 0.04491127 | 1.23 |
| hCV2104738 | yes | Discovery | Pool | All | T | 14.97% | 18.48% | 0.036903661 | 0.78 |
| hCV2104738 | yes | Replication, All Cases | Pool | All | T | 15.17% | 23.27% | 1.32407E-09 | 0.59 |
| hCV2104738 | yes | Replication, Probands | Pool | All | T | 15.00% | 23.29% | 2.69952E-07 | 0.58 |
| hCV2104738 | yes | Replication, All Cases | Pool | RF+ | T | 14.41% | 23.02% | 6.89913E-09 | 0.56 |
| hCV2104738 | yes | Replication, Probands | Pool | RF+ | T | 14.76% | 23.02% | 2.90912E-06 | 0.58 |
| hCV25627747 | yes | Discovery | Pool | All | T | 0.02% | 0.65% | 0.03100355 | 0.03 |
| hCV25627747 | yes | Replication, All Cases | Pool | All | T | 0.11% | 0.94% | 0.000892469 | 0.11 |
| hCV25627747 | yes | Replication, Probands | Pool | All | T | 0.06% | 0.95% | 0.010446397 | 0.06 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV25627747 | yes | Replication, All Cases | Pool | RF+ | T | 0.00% | 0.95% | 0.000121254 | 0.00 |
| hCV25627747 | yes | Replication, Probands | Pool | RF+ | T | 0.00% | 0.95% | 0.003981773 | 0.00 |
| hCV8719596 | yes | Discovery | Pool | All | T | 99.45% | 99.96% | 0.03108557 | 0.07 |
| hCV8719596 | yes | Replication, All Cases | Pool | All | T | 99.53% | 99.93% | 0.016485271 | 0.16 |
| hCV8719596 | yes | Replication, Probands | Pool | All | T | 99.43% | 99.92% | 0.017727182 | 0.13 |
| hCV8719596 | yes | Replication, All Cases | Pool | RF+ | T | 99.39% | 99.91% | 0.013757434 | 0.15 |
| hCV8719596 | yes | Replication, Probands | Pool | RF+ | T | 99.32% | 99.91% | 0.017708019 | 0.13 |
| hCV22274459 | yes | Discovery | Pool | All | C | 25.29% | 18.74% | 0.000596934 | 1.47 |
| hCV22274459 | yes | Replication, All Cases | Individual | All | C | 23.45% | 20.05% | 0.015722483 | 1.22 |
| hCV22274459 | yes | Replication, Probands | Individual | All | C | 23.65% | 20.05% | 0.030439024 | 1.23 |
| hCV25768636 | yes | Discovery | Pool | All | G | 67.22% | 72.47% | 0.0142237 | 0.78 |
| hCV25768636 | yes | Replication, All Cases | Pool | All | G | 66.35% | 69.78% | 0.032877444 | 0.85 |
| hCV7912061 | yes | Discovery | Pool | All | A | 21.16% | 26.51% | 0.006073849 | 0.74 |
| hCV7912061 | yes | Replication, All Cases | Pool | All | A | 23.69% | 28.80% | 0.000662293 | 0.77 |
| hCV7912061 | yes | Replication, Probands | Pool | All | A | 23.62% | 29.01% | 0.003015339 | 0.76 |
| hCV7912061 | yes | Replication, All Cases | Pool | RF+ | A | 24.60% | 28.56% | 0.01861363 | 0.82 |
| hCV7912061 | yes | Replication, Probands | Pool | RF+ | A | 24.38% | 28.56% | 0.037181438 | 0.81 |
| hCV7912052 | yes | Discovery | Individual | All | A | 27.30% | 34.50% | 0.000811571 | 0.71 |
| hCV7912052 | yes | Replication, Probands | Pool | All | A | 32.00% | 36.59% | 0.017247195 | 0.82 |
| hCV7912052 | yes | Replication, All Cases | Pool | All | A | 31.67% | 36.31% | 0.003991609 | 0.81 |
| hCV25607005 | yes | Discovery | Individual | All | A | 9.62% | 6.26% | 0.008008216 | 1.59 |
| hCV25607005 | yes | Replication, All Cases | Individual | All | A | 9.23% | 6.69% | 0.005770604 | 1.42 |
| hCV25607005 | yes | Replication, Probands | Individual | All | A | 8.84% | 6.69% | 0.04479743 | 1.35 |
| hCV25607005 | yes | Replication, All Cases | Individual | RF+ | A | 9.24% | 6.80% | 0.018517849 | 1.40 |
| hCV25933676 | yes | Discovery | Pool | All | T | 93.15% | 95.72% | 0.016620725 | 0.61 |
| hCV25933676 | yes | Replication, All Cases | Pool | All | T | 94.93% | 96.50% | 0.024061424 | 0.68 |
| hCV25933676 | yes | Replication, Probands | Pool | All | T | 94.32% | 96.49% | 0.008746611 | 0.60 |
| hCV9142770 | yes | Discovery | Pool | All | C | 35.44% | 30.14% | 0.014513671 | 1.27 |
| hCV9142770 | yes | Replication, All Cases | Pool | All | C | 36.70% | 31.10% | 0.000545921 | 1.28 |
| hCV9142770 | yes | Replication, Probands | Pool | All | C | 36.53% | 31.32% | 0.007444197 | 1.26 |
| hCV9142770 | yes | Replication, All Cases | Pool | RF+ | C | 37.11% | 30.44% | 0.000220965 | 1.35 |
| hCV9142770 | yes | Replication, Probands | Pool | RF+ | C | 36.99% | 30.44% | 0.001619195 | 1.34 |
| hCV12074801 | yes | Discovery | Pool | All | T | 24.17% | 19.13% | 0.007582014 | 1.35 |
| hCV12074801 | yes | Replication, All Cases | Pool | All | T | 24.79% | 21.97% | 0.046506951 | 1.17 |
| hCV12074801 | yes | Replication, Probands | Pool | All | T | 25.98% | 22.12% | 0.030906803 | 1.24 |
| hCV12074801 | yes | Replication, All Cases | Pool | RF+ | T | 25.90% | 22.36% | 0.02967123 | 1.21 |
| hCV12074801 | yes | Replication, Probands | Pool | RF+ | T | 26.96% | 22.36% | 0.014951763 | 1.28 |
| hCV11276786 | yes | Discovery | Pool | Male | T | 5.10% | 9.92% | 0.023537655 | 0.49 |
| hCV11276786 | yes | Replication, All Cases | Pool | Male | T | 3.95% | 10.30% | 0.002104266 | 0.36 |
| hCV25619242 | yes | Discovery | Pool | All | A | 16.28% | 21.76% | 0.0028552 | 0.70 |
| hCV25619242 | yes | Replication, All Cases | Individual | RF+ | A | 19.70% | 23.60% | 0.011436825 | 0.79 |
| hCV25636098 | yes | Discovery | Pool | All | A | 2.20% | 4.19% | 0.013585911 | 0.51 |
| hCV25636098 | yes | Replication, All Cases | Individual | All | A | 2.02% | 3.78% | 0.001966371 | 0.53 |
| hCV25636098 | yes | Replication, All Cases | Individual | RF+ | A | 1.70% | 3.96% | 0.00033036 | 0.42 |
| hCV25636098 | yes | Replication, Probands | Individual | RF+ | A | 1.95% | 3.96% | 0.009345542 | 0.48 |
| hCV8766013 | yes | Discovery | Pool | All | T | 56.91% | 52.34% | 0.047506349 | 1.20 |
| hCV8766013 | yes | Replication, All Cases | Pool | All | T | 56.60% | 51.78% | 0.004073975 | 1.21 |
| hCV8766013 | yes | Replication, Probands | Pool | All | T | 56.45% | 51.62% | 0.016391198 | 1.22 |
| hCV8766013 | yes | Replication, All Cases | Pool | RF+ | T | 57.64% | 51.68% | 0.00182079 | 1.27 |
| hCV8766013 | yes | Replication, Probands | Pool | RF+ | T | 57.05% | 51.68% | 0.016870774 | 1.24 |
| hCV8827110 | yes | Discovery | Pool | All | T | 25.78% | 35.94% | 2.28375E−06 | 0.62 |
| hCV8827110 | yes | Replication, All Cases | Pool | All | T | 25.91% | 31.36% | 0.000351363 | 0.77 |
| hCV8827110 | yes | Replication, Probands | Pool | All | T | 24.82% | 31.18% | 0.000572331 | 0.73 |
| hCV8827110 | yes | Replication, All Cases | Pool | RF+ | T | 24.73% | 30.88% | 0.000290143 | 0.74 |
| hCV8827110 | yes | Replication, Probands | Pool | RF+ | T | 24.42% | 30.88% | 0.001089677 | 0.72 |
| hCV11559107 | yes | Discovery | Pool | All | G | 81.34% | 85.75% | 0.011035042 | 0.72 |
| hCV11559107 | yes | Replication, All Cases | Pool | All | G | 79.13% | 84.63% | 2.49654E−05 | 0.69 |
| hCV11559107 | yes | Replication, Probands | Pool | All | G | 79.38% | 84.74% | 0.000543523 | 0.69 |
| hCV11559107 | yes | Replication, All Cases | Pool | RF+ | G | 78.57% | 84.06% | 0.000245648 | 0.70 |
| hCV11559107 | yes | Replication, Probands | Pool | RF+ | G | 79.11% | 84.06% | 0.003761844 | 0.72 |
| hCV25653443 | yes | Discovery | Pool | female | A | 0.15% | 1.52% | 0.011378829 | 0.10 |
| hCV25653443 | yes | Replication, Probands | Individual | female | A | 0.13% | 0.94% | 0.027291851 | 0.14 |
| hCV16046615 | yes | Discovery | Pool | All | T | 21.75% | 25.84% | 0.035953726 | 0.80 |
| hCV16046615 | yes | Replication, All Cases | Pool | All | T | 22.46% | 25.63% | 0.027439695 | 0.84 |
| hCV795929 | yes | Discovery | Pool | All | G | 14.21% | 18.85% | 0.006610958 | 0.71 |
| hCV795929 | yes | Replication, All Cases | Individual | All | G | 13.66% | 16.17% | 0.04112972 | 0.82 |
| hCV795929 | yes | Replication, Probands | Individual | All | G | 13.04% | 16.17% | 0.032069803 | 0.78 |
| hCV3191771 | yes | Discovery | Pool | HR-2SE | G | 77.85% | 85.67% | 0.028624479 | 0.59 |
| hCV3191771 | yes | Replication, Probands | Pool | HR-2SE | G | 71.95% | 78.12% | 0.025810501 | 0.72 |
| hCV2083657 | yes | Discovery | Pool | All | T | 7.97% | 5.33% | 0.021882828 | 1.54 |
| hCV2083657 | yes | Replication, All Cases | Pool | All | T | 7.33% | 5.35% | 0.01811205 | 1.40 |
| hCV2083657 | yes | Replication, Probands | Pool | All | T | 7.24% | 5.35% | 0.048866918 | 1.38 |
| hCV2083657 | yes | Replication, All Cases | Pool | RF+ | T | 7.09% | 5.23% | 0.047762772 | 1.38 |
| hCV25755889 | yes | Discovery | Pool | All | A | 99.30% | 99.94% | 0.038717379 | 0.09 |
| hCV25755889 | yes | Replication, All Cases | Pool | RF+ | A | 98.87% | 99.60% | 0.03980729 | 0.35 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV2926821 | yes | Discovery | Pool | All | T | 52.19% | 57.35% | 0.026900588 | 0.81 |
| hCV2926821 | yes | Replication, All Cases | Pool | All | T | 55.91% | 61.41% | 0.001014958 | 0.80 |
| hCV2926821 | yes | Replication, All Cases | Pool | RF+ | T | 56.11% | 61.22% | 0.00629113 | 0.81 |
| hCV652816 | yes | Discovery | Pool | All | T | 33.74% | 29.10% | 0.033450119 | 1.24 |
| hCV652816 | yes | Replication, All Cases | Pool | All | T | 32.00% | 28.29% | 0.01692692 | 1.19 |
| hCV652816 | yes | Replication, Probands | Pool | All | T | 32.07% | 28.33% | 0.045430523 | 1.19 |
| hCV11972326 | yes | Discovery | Pool | All | G | 20.90% | 25.02% | 0.033687969 | 0.79 |
| hCV11972326 | yes | Replication, All Cases | Pool | RF+ | G | 19.03% | 23.33% | 0.005565171 | 0.77 |
| hCV11972326 | yes | Replication, Probands | Pool | RF+ | G | 18.40% | 23.33% | 0.007416424 | 0.74 |
| hCV25756622 | yes | Discovery | Pool | All | G | 79.76% | 75.79% | 0.04105929 | 1.26 |
| hCV25756622 | yes | Replication, All Cases | Pool | All | G | 80.84% | 77.75% | 0.024980353 | 1.21 |
| hCV25756622 | yes | Replication, Probands | Pool | All | G | 83.00% | 77.85% | 0.00178917 | 1.39 |
| hCV25756622 | yes | Replication, All Cases | Pool | RF+ | G | 81.99% | 78.55% | 0.022761669 | 1.24 |
| hCV25756622 | yes | Replication, Probands | Pool | RF+ | G | 83.43% | 78.55% | 0.006642366 | 1.37 |
| hCV7461647 | yes | Discovery | Pool | All | G | 5.72% | 8.19% | 0.037611465 | 0.68 |
| hCV7461647 | yes | Replication, All Cases | Pool | RF+ | G | 6.82% | 9.00% | 0.03644323 | 0.74 |
| hCV3266627 | yes | Discovery | Pool | HR-1SE | C | 31.56% | 47.69% | 0.009111669 | 0.51 |
| hCV3266627 | yes | Replication, All Cases | Individual | HR-1SE | C | 43.89% | 50.17% | 0.036753395 | 0.78 |
| hCV3266627 | yes | Discovery | Pool | Onset <38 | C | 32.46% | 45.57% | 0.004692968 | 0.57 |
| hCV3266627 | yes | Replication, Probands | Individual | Onset <38 | C | 42.68% | 49.03% | 0.039399438 | 0.77 |
| hCV9487784 | yes | Discovery | Pool | All | A | 23.52% | 12.72% | 1.41814E−09 | 2.11 |
| hCV9487784 | yes | Replication, All Cases | Individual | All | A | 36.07% | 14.15% | 2.38499E−52 | 3.42 |
| hCV9487784 | yes | Replication, Probands | Individual | All | A | 35.53% | 14.15% | 9.20159E−37 | 3.34 |
| hCV9487784 | yes | Replication, All Cases | Individual | RF+ | A | 38.61% | 14.42% | 2.07661E−50 | 3.73 |
| hCV9487784 | yes | Replication, Probands | Individual | RF+ | A | 38.18% | 14.42% | 2.02007E−36 | 3.67 |
| hCV3248144 | yes | Discovery | Pool | HR-2SE | T | 17.03% | 25.06% | 0.048182229 | 0.61 |
| hCV3248144 | yes | Replication, Probands | Pool | HR-2SE | T | 13.34% | 20.09% | 0.006003298 | 0.61 |
| hCV25744634 | yes | Discovery | Pool | All | T | 2.87% | 7.58% | 2.63952E−06 | 0.36 |
| hCV25744634 | yes | Replication, All Cases | Individual | All | T | 3.65% | 6.97% | 1.21172E−05 | 0.51 |
| hCV25744634 | yes | Replication, Probands | Individual | All | T | 3.25% | 6.97% | 3.98118E−05 | 0.45 |
| hCV25744634 | yes | Replication, All Cases | Individual | RF+ | T | 3.49% | 6.81% | 7.02219E−05 | 0.49 |
| hCV25744634 | yes | Replication, Probands | Individual | RF+ | T | 3.13% | 6.81% | 0.000215344 | 0.44 |
| hCV15760047 | yes | Discovery | Pool | All | G | 2.98% | 4.81% | 0.033393769 | 0.61 |
| hCV15760047 | yes | Replication, All Cases | Pool | All | G | 2.20% | 4.46% | 0.000180957 | 0.48 |
| hCV15760047 | yes | Replication, Probands | Pool | All | G | 2.37% | 4.45% | 0.007682849 | 0.52 |
| hCV15760047 | yes | Replication, All Cases | Pool | RF+ | G | 1.74% | 4.45% | 5.41433E−05 | 0.38 |
| hCV15760047 | yes | Replication, Probands | Pool | RF+ | G | 1.93% | 4.45% | 0.001992502 | 0.42 |
| hCV8301529 | yes | Discovery | Pool | All | C | 92.07% | 94.55% | 0.035029178 | 0.67 |
| hCV8301529 | yes | Replication, All Cases | Pool | All | C | 91.78% | 94.26% | 0.004204353 | 0.68 |
| hCV8301529 | yes | Replication, Probands | Pool | All | C | 92.15% | 94.27% | 0.038345289 | 0.71 |
| hCV8301529 | yes | Replication, All Cases | Pool | RF+ | C | 91.99% | 94.51% | 0.009615307 | 0.67 |
| hCV8301529 | yes | Replication, Probands | Pool | RF+ | C | 92.05% | 94.51% | 0.029291017 | 0.67 |
| hCV25759203 | yes | Discovery | Pool | Female | T | 95.14% | 97.64% | 0.023252337 | 0.47 |
| hCV25759203 | yes | Replication, All Cases | Pool | Female | T | 94.99% | 96.72% | 0.026271509 | 0.64 |
| hCV25747791 | yes | Discovery | Pool | All | G | 99.59% | 98.15% | 0.002466592 | 4.54 |
| hCV25747791 | yes | Replication, All Cases | Pool | All | G | 99.76% | 99.19% | 0.021535469 | 3.36 |
| hCV8303385 | yes | Discovery | Individual | All | T | 17.31% | 13.35% | 0.017853995 | 1.36 |
| hCV8303385 | yes | Replication, All Cases | Individual | All | T | 16.91% | 13.28% | 0.002909867 | 1.33 |
| hCV25650933 | yes | Discovery | Individual | All | T | 16.45% | 11.36% | 0.00167969 | 1.54 |
| hCV25650933 | yes | Replication, All Cases | Individual | All | T | 15.27% | 11.83% | 0.003020328 | 1.34 |
| hCV25650933 | yes | Replication, Probands | Individual | All | T | 14.83% | 11.83% | 0.030003238 | 1.30 |
| hCV25930645 | yes | Discovery | Pool | HR-2SE | A | 95.58% | 99.95% | 0.000881309 | 0.01 |
| hCV25930645 | yes | Replication, Probands | Pool | HR-2SE | A | 95.38% | 98.28% | 0.012998803 | 0.36 |
| hCV2619261 | yes | Discovery | Pool | All | T | 32.93% | 38.68% | 0.009817998 | 0.78 |
| hCV2619261 | yes | Replication, All Cases | Pool | All | T | 33.36% | 39.27% | 0.000271555 | 0.77 |
| hCV2619261 | yes | Replication, Probands | Pool | All | T | 33.12% | 39.63% | 0.000916519 | 0.75 |
| hCV2619261 | yes | Replication, All Cases | Pool | RF+ | T | 33.08% | 39.04% | 0.001080682 | 0.77 |
| hCV2619261 | yes | Replication, Probands | Pool | RF+ | T | 33.16% | 39.04% | 0.006093006 | 0.77 |
| hCV2950320 | yes | Discovery | Pool | Male | T | 14.36% | 7.47% | 0.007486426 | 2.08 |
| hCV2950320 | yes | Replication, All Cases | Pool | Male | T | 13.20% | 6.35% | 0.003257151 | 2.24 |
| hCV2950320 | yes | Replication, Probands | Pool | Male | T | 14.26% | 6.35% | 0.005992173 | 2.45 |
| hCV25934391 | yes | Discovery | Pool | HR-1SE | G | 72.83% | 85.14% | 0.011818004 | 0.47 |
| hCV25934391 | yes | Replication, Probands | Pool | HR-1SE | G | 80.50% | 87.05% | 0.018454692 | 0.61 |
| hCV2744375 | yes | Discovery | Pool | All | T | 88.63% | 92.03% | 0.015994155 | 0.67 |
| hCV2744375 | yes | Replication, All Cases | Pool | All | T | 89.61% | 91.58% | 0.043198675 | 0.79 |
| hCV25972553 | yes | Discovery | Pool | All | T | 57.47% | 52.42% | 0.027015382 | 1.23 |
| hCV25972553 | yes | Replication, All Cases | Pool | All | T | 55.69% | 50.00% | 0.000738409 | 1.26 |
| hCV25972553 | yes | Replication, Probands | Pool | All | T | 55.79% | 50.00% | 0.004443393 | 1.26 |
| hCV25972553 | yes | Replication, All Cases | Pool | RF+ | T | 55.51% | 49.34% | 0.0012697 | 1.28 |
| hCV25972553 | yes | Replication, Probands | Pool | RF+ | T | 55.14% | 49.34% | 0.008110305 | 1.26 |
| hCV25473136 | yes | Discovery | Pool | Male | T | 91.88% | 83.43% | 0.001172864 | 2.25 |
| hCV25473136 | yes | Replication, All Cases | Pool | Male | T | 90.99% | 81.36% | 0.000374319 | 2.31 |
| hCV25473136 | yes | Replication, Probands | Pool | Male | T | 89.32% | 81.36% | 0.024670283 | 1.92 |
| hCV1413258 | yes | Discovery | Pool | Female | G | 82.09% | 74.90% | 0.001590237 | 1.54 |
| hCV1413258 | yes | Replication, All Cases | Pool | Female | G | 78.57% | 73.98% | 0.004948573 | 1.29 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV1413258 | yes | Replication, Probands | Pool | Female | G | 78.56% | 73.98% | 0.019266924 | 1.29 |
| hCV1413258 | yes | Discovery | Pool | HR-1SE | G | 81.46% | 70.38% | 0.046033661 | 1.85 |
| hCV1413258 | yes | Replication, Probands | Pool | HR-1SE | G | 81.36% | 74.83% | 0.04426868 | 1.47 |
| hCV11720402 | yes | Discovery | Pool | All | T | 39.31% | 44.70% | 0.01773467 | 0.80 |
| hCV11720402 | yes | Replication, All Cases | Pool | All | T | 40.22% | 45.27% | 0.002741399 | 0.81 |
| hCV11720402 | yes | Replication, Probands | Pool | All | T | 40.84% | 45.10% | 0.036902948 | 0.84 |
| hCV11720402 | yes | Replication, All Cases | Pool | RF+ | T | 40.64% | 45.91% | 0.005312239 | 0.81 |
| hCV11720402 | yes | Replication, Probands | Pool | RF+ | T | 40.27% | 45.91% | 0.009968486 | 0.79 |
| hCV25472930 | yes | Discovery | Pool | Female | C | 9.95% | 6.00% | 0.016146024 | 1.73 |
| hCV25472930 | yes | Replication, Probands | Pool | Female | C | 8.93% | 6.47% | 0.038767083 | 1.42 |
| hCV2004708 | yes | Discovery | Pool | LR-1SE | C | 32.28% | 60.36% | 0.005596267 | 0.31 |
| hCV2004708 | yes | Replication, Probands | Pool | LR-1SE | C | 38.23% | 55.85% | 0.032904768 | 0.49 |
| hCV25640226 | yes | Discovery | Pool | All | C | 91.63% | 88.76% | 0.030924151 | 1.39 |
| hCV25640226 | yes | Replication, All Cases | Pool | All | C | 91.02% | 88.12% | 0.005950157 | 1.37 |
| hCV25640226 | yes | Replication, Probands | Pool | All | C | 90.67% | 88.08% | 0.044790792 | 1.31 |
| hCV25640226 | yes | Replication, All Cases | Pool | RF+ | C | 91.35% | 88.25% | 0.007425925 | 1.41 |
| hCV25640226 | yes | Replication, Probands | Pool | RF+ | C | 91.13% | 88.25% | 0.032892031 | 1.37 |
| hCV11597077 | yes | Discovery | Pool | All | A | 46.34% | 51.24% | 0.031144846 | 0.82 |
| hCV11597077 | yes | Replication, All Cases | Individual | RF+ | A | 45.04% | 48.96% | 0.036466659 | 0.85 |
| hCV1839329 | yes | Discovery | Pool | All | G | 45.62% | 50.17% | 0.04350832 | 0.83 |
| hCV1839329 | yes | Replication, All Cases | Individual | RF+ | G | 45.12% | 48.95% | 0.039858409 | 0.86 |
| hCV11735875 | yes | Discovery | Pool | HR-1SE | C | 20.75% | 8.48% | 0.009569938 | 2.82 |
| hCV11735875 | yes | Replication, Probands | Individual | HR-1SE | C | 18.03% | 11.22% | 0.006484705 | 1.74 |
| hCV1253735 | yes | Discovery | Pool | All | T | 84.32% | 88.11% | 0.016722125 | 0.73 |
| hCV1253735 | yes | Replication, All Cases | Pool | All | T | 84.06% | 87.67% | 0.001912589 | 0.74 |
| hCV1253735 | yes | Replication, Probands | Pool | All | T | 84.26% | 87.62% | 0.017369356 | 0.76 |
| hCV1773247 | yes | Discovery | Pool | All | T | 6.36% | 8.74% | 0.045985585 | 0.71 |
| hCV1773247 | yes | Replication, All Cases | Pool | All | T | 5.69% | 8.12% | 0.005436031 | 0.68 |
| hCV1773247 | yes | Replication, Probands | Pool | All | T | 5.84% | 8.25% | 0.024677255 | 0.69 |
| hCV1773247 | yes | Replication, All Cases | Pool | RF+ | T | 5.90% | 8.58% | 0.007182091 | 0.67 |
| hCV1773247 | yes | Replication, Probands | Pool | RF+ | T | 5.98% | 8.58% | 0.031138079 | 0.68 |
| hCV16142950 | yes | Discovery | Pool | All | G | 41.72% | 46.94% | 0.02361255 | 0.81 |
| hCV16142950 | yes | Replication, All Cases | Pool | All | G | 46.59% | 51.06% | 0.00856573 | 0.84 |
| hCV16142950 | yes | Replication, All Cases | Pool | RF+ | G | 45.24% | 50.92% | 0.002756781 | 0.80 |
| hCV25592530 | yes | Discovery | Pool | Female | T | 13.90% | 19.51% | 0.008024342 | 0.67 |
| hCV25592530 | yes | Replication, Probands | Pool | Female | T | 16.06% | 20.60% | 0.008827259 | 0.74 |
| hCV11758437 | yes | Discovery | Pool | All | G | 58.30% | 63.51% | 0.021357508 | 0.80 |
| hCV11758437 | yes | Replication, All Cases | Pool | All | G | 55.07% | 59.27% | 0.011734382 | 0.84 |
| hCV204710 | yes | Discovery | Pool | All | G | 73.30% | 77.70% | 0.028736073 | 0.79 |
| hCV204710 | yes | Replication, All Cases | Pool | RF+ | G | 75.14% | 78.99% | 0.014702128 | 0.80 |
| hCV8915168 | yes | Discovery | Individual | All | A | 24.03% | 29.83% | 0.004893574 | 0.74 |
| hCV8915168 | yes | Replication, All Cases | Individual | All | A | 24.46% | 28.79% | 0.003802791 | 0.80 |
| hCV8915168 | yes | Replication, Probands | Individual | All | A | 24.30% | 28.79% | 0.01291231 | 0.79 |
| hCV8915168 | yes | Replication, All Cases | Individual | RF+ | A | 23.67% | 28.52% | 0.003439631 | 0.78 |
| hCV8915168 | yes | Replication, Probands | Individual | RF+ | A | 22.99% | 28.52% | 0.005147306 | 0.75 |
| hCV443471 | yes | Discovery | Individual | HR-2SE | T | 31.15% | 39.69% | 0.044411024 | 0.69 |
| hCV443471 | yes | Replication, All Cases | Individual | HR-2SE | T | 30.84% | 38.61% | 0.002059442 | 0.71 |
| hCV25606714 | yes | Discovery | Pool | Male | G | 95.81% | 98.86% | 0.046126005 | 0.26 |
| hCV25606714 | yes | Replication, Probands | Pool | Male | G | 96.76% | 99.38% | 0.044064752 | 0.19 |
| hCV25606714 | yes | Discovery | Pool | LR-0SE | G | 93.52% | 99.98% | 0.029253637 | 0.00 |
| hCV25606714 | yes | Replication, Probands | Pool | LR-0SE | G | 93.05% | 99.50% | 0.016507932 | 0.07 |
| hCV25992555 | yes | Discovery | Pool | All | G | 99.83% | 98.96% | 0.037981673 | 6.11 |
| hCV25992555 | yes | Replication, All Cases | Pool | All | G | 99.81% | 98.46% | 1.19354E−05 | 8.09 |
| hCV25992555 | yes | Replication, Probands | Pool | All | G | 99.80% | 98.44% | 0.001308492 | 7.90 |
| hCV25992555 | yes | Replication, All Cases | Pool | RF+ | G | 99.98% | 98.49% | 1.20186E−06 | 72.68 |
| hCV25992555 | yes | Replication, Probands | Pool | RF+ | G | 99.98% | 98.49% | 0.000159669 | 68.56 |
| hCV3246662 | yes | Discovery | Pool | Female | T | 28.61% | 35.86% | 0.007863989 | 0.72 |
| hCV3246662 | yes | Replication, All Cases | Pool | Female | T | 29.97% | 34.12% | 0.020251551 | 0.83 |
| hCV25608626 | yes | Discovery | Pool | All | G | 86.02% | 82.47% | 0.032646381 | 1.31 |
| hCV25608626 | yes | Replication, All Cases | Pool | RF+ | G | 83.04% | 80.05% | 0.045922497 | 1.22 |
| hCV11356754 | yes | Discovery | Pool | All | T | 55.31% | 59.83% | 0.046168174 | 0.83 |
| hCV11356754 | yes | Replication, All Cases | Pool | All | T | 58.24% | 61.89% | 0.027662855 | 0.86 |
| hCV11356754 | yes | Replication, Probands | Pool | All | T | 57.45% | 61.84% | 0.030908833 | 0.83 |
| hCV11356754 | yes | Replication, All Cases | Pool | RF+ | T | 56.91% | 61.76% | 0.0097314 | 0.82 |
| hCV11356754 | yes | Replication, Probands | Pool | RF+ | T | 57.29% | 61.76% | 0.042384241 | 0.83 |
| hCV730311 | yes | Discovery | Pool | Onset 38-55 | T | 6.19% | 2.50% | 0.004465734 | 2.57 |
| hCV730311 | yes | Replication, All Cases | Individual | Onset 38-55 | T | 5.47% | 3.04% | 0.017325269 | 1.84 |
| hCV25960573 | yes | Discovery | Pool | All | G | 20.26% | 24.58% | 0.027949114 | 0.78 |
| hCV25960573 | yes | Replication, All Cases | Pool | RF+ | G | 20.99% | 25.31% | 0.007209935 | 0.78 |
| hCV1671515 | yes | Discovery | Pool | Female | T | 81.36% | 75.34% | 0.011171605 | 1.43 |
| hCV1671515 | yes | Replication, All Cases | Pool | Female | T | 79.06% | 75.46% | 0.026482124 | 1.23 |
| hCV1671515 | yes | Replication, Probands | Pool | Female | T | 79.69% | 75.46% | 0.025821619 | 1.28 |
| hCV16062492 | yes | Discovery | Pool | LR-1SE | G | 73.35% | 52.43% | 0.037656345 | 2.50 |
| hCV16062492 | yes | Replication, Probands | Pool | LR-1SE | G | 76.73% | 55.63% | 0.00713712 | 2.63 |
| hCV25983354 | yes | Discovery | Pool | Male | G | 0.01% | 4.35% | 5.28316E−05 | 0.00 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV25983354 | yes | Replication, All Cases | Pool | Male | G | 0.01% | 6.15% | 6.58998E−07 | 0.00 |
| hCV25983354 | yes | Replication, Probands | Pool | Male | G | 0.01% | 6.15% | 0.000366416 | 0.00 |
| hCV25983354 | yes | Discovery | Pool | HR-1SE | G | 0.00% | 10.30% | 4.29167E−05 | 0.00 |
| hCV25983354 | yes | Replication, Probands | Pool | HR-1SE | G | 0.00% | 10.23% | 4.96093E−10 | 0.00 |
| hCV25747046 | yes | Discovery | Pool | Female | G | 10.87% | 15.11% | 0.028795907 | 0.69 |
| hCV25747046 | yes | Replication, All Cases | Pool | Female | G | 13.12% | 16.65% | 0.010556758 | 0.76 |
| hCV1815793 | yes | Discovery | Pool | HR-2SE | T | 35.88% | 49.40% | 0.004101901 | 0.57 |
| hCV1815793 | yes | Replication, Probands | Pool | HR-2SE | T | 36.93% | 45.44% | 0.011611886 | 0.70 |
| hCV11297739 | yes | Discovery | Pool | All | T | 15.15% | 11.92% | 0.037849694 | 1.32 |
| hCV11297739 | yes | Replication, All Cases | Pool | All | T | 14.03% | 11.01% | 0.00683445 | 1.32 |
| hCV11297739 | yes | Replication, Probands | Pool | All | T | 14.10% | 10.91% | 0.020584376 | 1.34 |
| hCV11297739 | yes | Replication, All Cases | Pool | RF+ | T | 14.41% | 11.27% | 0.014462494 | 1.33 |
| hCV11297739 | yes | Replication, Probands | Pool | RF+ | T | 14.61% | 11.27% | 0.027092349 | 1.35 |
| hCV7586912 | yes | Discovery | Pool | All | T | 76.15% | 71.00% | 0.014418809 | 1.30 |
| hCV7586912 | yes | Replication, Probands | Pool | All | T | 78.19% | 74.77% | 0.046254089 | 1.21 |
| hCV16166772 | yes | Discovery | Pool | All | C | 12.33% | 9.41% | 0.03914869 | 1.35 |
| hCV16166772 | yes | Replication, All Cases | Pool | All | C | 10.02% | 7.91% | 0.03335215 | 1.30 |
| hCV16166772 | yes | Replication, All Cases | Pool | RF+ | C | 10.12% | 7.62% | 0.018974499 | 1.36 |
| hCV25942539 | yes | Discovery | Pool | All | A | 34.48% | 29.38% | 0.016005087 | 1.26 |
| hCV25942539 | yes | Replication, Probands | Pool | All | A | 37.80% | 33.06% | 0.015056544 | 1.23 |
| hCV3076433 | yes | Discovery | Pool | All | T | 26.07% | 35.44% | 1.19047E−05 | 0.64 |
| hCV3076433 | yes | Replication, All Cases | Individual | RF + | T | 31.18% | 35.59% | 0.012681072 | 0.82 |
| hCV3015606 | yes | Discovery | Pool | All | T | 46.37% | 50.93% | 0.043615926 | 0.83 |
| hCV3015606 | yes | Replication, All Cases | Pool | All | T | 47.40% | 52.07% | 0.005736671 | 0.83 |
| hCV3015606 | yes | Replication, All Cases | Pool | RF+ | T | 47.83% | 52.43% | 0.015394887 | 0.83 |
| hCV3015606 | yes | Replication, Probands | Pool | RF+ | T | 47.76% | 52.43% | 0.038060373 | 0.83 |
| hCV9283503 | yes | Discovery | Pool | All | G | 48.76% | 55.50% | 0.003801901 | 0.76 |
| hCV9283503 | yes | Replication, All Cases | Pool | All | G | 50.28% | 54.70% | 0.009380237 | 0.84 |
| hCV9283503 | yes | Replication, Probands | Pool | All | G | 50.21% | 54.45% | 0.038082293 | 0.84 |
| hCV9283503 | yes | Replication, All Cases | Pool | RF+ | G | 50.17% | 55.21% | 0.007932113 | 0.82 |
| hCV9283503 | yes | Replication, Probands | Pool | RF+ | G | 50.09% | 55.21% | 0.024005749 | 0.81 |
| hCV1248029 | yes | Discovery | Pool | All | G | 49.80% | 42.79% | 0.002382314 | 1.33 |
| hCV1248029 | yes | Replication, All Cases | Individual | All | G | 47.67% | 43.08% | 0.006722118 | 1.20 |
| hCV1248029 | yes | Replication, All Cases | Individual | RF+ | G | 47.40% | 42.91% | 0.016405472 | 1.20 |
| hCV2095401 | yes | Discovery | Pool | Male | G | 67.65% | 75.90% | 0.028526168 | 0.66 |
| hCV2095401 | yes | Replication, Probands | Pool | Male | G | 60.87% | 73.06% | 0.006459057 | 0.57 |
| hCV3226838 | yes | Discovery | Pool | Male | G | 41.54% | 55.23% | 0.000685889 | 0.58 |
| hCV3226838 | yes | Replication, All Cases | Pool | Male | G | 42.07% | 51.68% | 0.017571452 | 0.68 |
| hCV3226838 | yes | Replication, Probands | Pool | Male | G | 40.04% | 51.68% | 0.019922507 | 0.62 |
| hCV1283127 | yes | Discovery | Individual | All | G | 26.66% | 33.01% | 0.002860114 | 0.74 |
| hCV1283127 | yes | Replication, All Cases | Individual | All | G | 27.56% | 30.67% | 0.045376785 | 0.86 |
| hCV1283127 | yes | Replication, All Cases | Individual | RF+ | G | 27.88% | 31.49% | 0.037702138 | 0.84 |
| hCV1283131 | yes | Discovery | Individual | All | C | 12.66% | 9.34% | 0.022171575 | 1.41 |
| hCV1283131 | yes | Replication, All Cases | Individual | All | C | 14.64% | 9.23% | 6.62902E−07 | 1.69 |
| hCV1283131 | yes | Replication, Probands | Individual | All | C | 15.12% | 9.23% | 5.44977E−06 | 1.75 |
| hCV1283131 | yes | Replication, All Cases | Individual | RF+ | C | 15.53% | 9.16% | 1.83404E−07 | 1.82 |
| hCV1283131 | yes | Replication, Probands | Individual | RF+ | C | 15.58% | 9.16% | 7.31461E−06 | 1.83 |
| hCV9692842 | yes | Discovery | Individual | All | T | 17.95% | 14.12% | 0.027583095 | 1.33 |
| hCV9692842 | yes | Replication, Probands | Pool | All | T | 18.57% | 12.61% | 4.22269E−05 | 1.58 |
| hCV9692842 | yes | Replication, Probands | Pool | RF+ | T | 19.49% | 12.24% | 4.81155E−06 | 1.74 |
| hCV9692842 | yes | Replication, All Cases | Pool | All | T | 19.44% | 12.59% | 2.81804E−08 | 1.67 |
| hCV9692842 | yes | Replication, All Cases | Pool | RF+ | T | 21.10% | 12.24% | 2.22566E−10 | 1.92 |
| hCV1231817 | yes | Discovery | Pool | Female | T | 60.77% | 67.35% | 0.016022557 | 0.75 |
| hCV1231817 | yes | Replication, All Cases | Pool | Female | T | 58.89% | 63.28% | 0.021130308 | 0.83 |
| hCV11514490 | yes | Discovery | Pool | male | A | 16.03% | 10.49% | 0.048434467 | 1.63 |
| hCV11514490 | yes | Replication, Probands | Individual | male | A | 17.61% | 11.08% | 0.041511164 | 1.72 |
| hCV15976147 | yes | Discovery | Individual | All | G | 1.71% | 0.53% | 0.015908686 | 3.27 |
| hCV15976147 | yes | Replication, All Cases | Individual | All | G | 1.25% | 0.38% | 0.003891619 | 3.34 |
| hCV15976147 | yes | Replication, Probands | Individual | All | G | 1.19% | 0.38% | 0.02080022 | 3.17 |
| hCV15976147 | yes | Replication, All Cases | Individual | RF+ | G | 1.41% | 0.45% | 0.009091213 | 3.13 |
| hCV15976147 | yes | Replication, Probands | Individual | RF+ | G | 1.43% | 0.45% | 0.020719529 | 3.17 |
| hCV16194374 | yes | Discovery | Pool | All | G | 4.08% | 6.55% | 0.024035986 | 0.61 |
| hCV16194374 | yes | Replication, All Cases | Pool | RF+ | C | 5.12% | 7.31% | 0.015852406 | 0.68 |
| hCV16194374 | yes | Discovery | Pool | Male | C | 2.98% | 6.79% | 0.044519945 | 0.42 |
| hCV16194374 | yes | Replication, All Cases | Pool | Male | C | 3.90% | 8.25% | 0.032368257 | 0.45 |
| hCV9272397 | yes | Discovery | Pool | All | A | 49.21% | 42.07% | 0.002022714 | 1.33 |
| hCV9272397 | yes | Replication, All Cases | Individual | All | A | 49.76% | 44.18% | 0.001025442 | 1.25 |
| hCV9272397 | yes | Replication, Probands | Individual | All | A | 49.78% | 44.18% | 0.005894549 | 1.25 |
| hCV9272397 | yes | Replication, All Cases | Individual | RF+ | A | 50.82% | 43.72% | 0.000155648 | 1.33 |
| hCV9272397 | yes | Replication, Probands | Individual | RF+ | A | 50.39% | 43.72% | 0.002535487 | 1.31 |
| hCV25924724 | yes | Discovery | Pool | All | T | 83.42% | 86.75% | 0.046080833 | 0.77 |
| hCV25924724 | yes | Replication, All Cases | Pool | All | T | 83.18% | 85.64% | 0.045520864 | 0.83 |
| hCV25924724 | yes | Replication, Probands | Pool | All | T | 82.49% | 85.53% | 0.043158192 | 0.80 |
| hCV25924724 | yes | Replication, All Cases | Pool | RF+ | T | 82.91% | 85.62% | 0.047355326 | 0.81 |
| hCV25993353 | yes | Discovery | Pool | All | G | 24.74% | 20.63% | 0.037297858 | 1.26 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV25993353 | yes | Replication, All Cases | Pool | All | G | 19.63% | 16.90% | 0.03615817 | 1.20 |
| hCV7454533 | yes | Discovery | Pool | Male | T | 40.92% | 50.50% | 0.017589388 | 0.68 |
| hCV7454533 | yes | Replication, All Cases | Pool | Male | T | 42.31% | 50.30% | 0.04774614 | 0.72 |
| hCV549404 | yes | Discovery | Pool | LR-0SE | G | 8.76% | 0.36% | 0.013576787 | 26.79 |
| hCV549404 | yes | Replication, Probands | Pool | LR-0SE | G | 13.41% | 4.04% | 0.013863131 | 3.68 |
| hCV25641653 | yes | Discovery | Individual | All | G | 43.05% | 49.68% | 0.001749155 | 0.75 |
| hCV25641653 | yes | Replication, Probands | Individual | RF+ | G | 45.97% | 50.52% | 0.042230374 | 0.83 |
| hCV15881845 | yes | Discovery | Individual | All | C | 5.27% | 7.58% | 0.048985507 | 0.68 |
| hCV15881845 | yes | Replication, All Cases | Individual | All | C | 5.36% | 7.02% | 0.043262494 | 0.75 |
| hCV15881845 | yes | Replication, All Cases | Individual | RF+ | C | 4.66% | 6.95% | 0.008969727 | 0.65 |
| hCV25967527 | yes | Discovery | Pool | All | C | 99.73% | 98.52% | 0.007299426 | 5.58 |
| hCV25967527 | yes | Replication, All Cases | Pool | All | C | 99.45% | 98.84% | 0.046088278 | 2.15 |
| hCV25967527 | yes | Replication, All Cases | Pool | RF+ | C | 99.60% | 98.85% | 0.03316308 | 2.91 |
| hCV8714838 | yes | Discovery | Pool | All | G | 38.89% | 43.93% | 0.025484527 | 0.81 |
| hCV8714838 | yes | Replication, All Cases | Individual | All | G | 40.57% | 44.69% | 0.014069995 | 0.85 |
| hCV2936823 | yes | Discovery | Pool | All | T | 33.95% | 41.06% | 0.001755868 | 0.74 |
| hCV2936823 | yes | Replication, All Cases | Individual | All | T | 38.45% | 42.73% | 0.010750447 | 0.84 |
| hCV1654841 | yes | Discovery | Pool | Onset 38-55 | A | 32.19% | 41.02% | 0.003715442 | 0.68 |
| hCV1654841 | yes | Replication, All Cases | Individual | Onset 38-55 | A | 31.95% | 37.15% | 0.03116307 | 0.79 |
| hCV1654841 | yes | Replication, Probands | Individual | Onset 38-55 | A | 30.28% | 37.15% | 0.015329657 | 0.73 |
| hCV8954669 | yes | Discovery | Pool | Male | G | 37.27% | 46.93% | 0.013574462 | 0.67 |
| hCV8954669 | yes | Replication, Probands | Pool | Male | G | 37.37% | 48.36% | 0.025274815 | 0.64 |
| hCV25751699 | yes | Discovery | Pool | All | T | 57.03% | 62.54% | 0.016996032 | 0.79 |
| hCV25751699 | yes | Replication, All Cases | Pool | All | T | 61.36% | 65.04% | 0.023138645 | 0.85 |
| hCV25745882 | yes | Discovery | Pool | Male | A | 29.76% | 39.49% | 0.012880766 | 0.65 |
| hCV25745882 | yes | Replication, All Cases | Pool | Male | A | 28.23% | 38.44% | 0.007333812 | 0.63 |
| hCV16229390 | yes | Discovery | Individual | All | G | 27.67% | 33.58% | 0.00591709 | 0.76 |
| hCV16229390 | yes | Replication, All Cases | Individual | All | G | 29.38% | 35.03% | 0.000359481 | 0.77 |
| hCV16229390 | yes | Replication, Probands | Individual | All | G | 28.14% | 35.03% | 0.000262438 | 0.73 |
| hCV16229390 | yes | Replication, All Cases | Individual | RF+ | G | 28.85% | 34.94% | 0.000511784 | 0.76 |
| hCV16229390 | yes | Replication, Probands | Individual | RF+ | G | 27.40% | 34.94% | 0.000279774 | 0.70 |
| hCV7499127 | yes | Discovery | Pool | All | G | 31.74% | 36.50% | 0.026144581 | 0.81 |
| hCV7499127 | yes | Replication, All Cases | Pool | All | G | 31.52% | 39.99% | 1.6743E-07 | 0.69 |
| hCV7499127 | yes | Replication, Probands | Pool | All | G | 30.16% | 40.08% | 4.25266E-07 | 0.65 |
| hCV7499127 | yes | Replication, All Cases | Pool | RF+ | G | 30.89% | 39.69% | 1.41213E-06 | 0.68 |
| hCV7499127 | yes | Replication, Probands | Pool | RF+ | G | 30.09% | 39.69% | 6.88819E-06 | 0.65 |
| hCV1709713 | yes | Discovery | Pool | All | G | 8.29% | 11.96% | 0.007908651 | 0.67 |
| hCV1709713 | yes | Replication, Probands | Individual | All | G | 7.38% | 10.21% | 0.014851566 | 0.70 |
| hCV1709713 | yes | Replication, All Cases | Individual | RF+ | G | 8.26% | 10.55% | 0.040867294 | 0.76 |
| hCV1709713 | yes | Replication, Probands | Individual | RF+ | G | 7.18% | 10.55% | 0.009834543 | 0.66 |
| hCV16006940 | yes | Discovery | Pool | All | C | 45.01% | 49.68% | 0.043403566 | 0.83 |
| hCV16006940 | yes | Replication, All Cases | Individual | RF+ | C | 47.71% | 52.01% | 0.022983979 | 0.84 |
| hCV1724443 | yes | Discovery | Pool | All | G | 43.39% | 49.90% | 0.004383893 | 0.77 |
| hCV1724443 | yes | Replication, All Cases | Individual | All | G | 38.65% | 42.32% | 0.027901318 | 0.86 |
| hCV1724443 | yes | Replication, All Cases | Individual | RF+ | G | 37.19% | 42.38% | 0.004822046 | 0.80 |
| hCV773663 | yes | Discovery | Pool | All | G | 9.09% | 5.28% | 0.030980252 | 1.49 |
| hCV773663 | yes | Replication, All Cases | Pool | All | G | 7.03% | 5.19% | 0.023776666 | 1.38 |
| hCV773663 | yes | Replication, All Cases | Pool | RF+ | G | 7.48% | 5.25% | 0.018813069 | 1.46 |
| hCV2628820 | yes | Discovery | Pool | All | C | 75.02% | 79.09% | 0.043446577 | 0.79 |
| hCV2628820 | yes | Replication, All Cases | Pool | All | C | 76.71% | 80.83% | 0.002958868 | 0.78 |
| hCV2628820 | yes | Replication, Probands | Pool | All | C | 76.61% | 80.96% | 0.008924443 | 0.77 |
| hCV2628820 | yes | Replication, All Cases | Pool | RF+ | C | 76.13% | 80.92% | 0.002241465 | 0.75 |
| hCV2628820 | yes | Replication, Probands | Pool | RF+ | C | 76.00% | 80.92% | 0.00647635 | 0.75 |
| hCV589914 | yes | Discovery | Pool | All | G | 53.70% | 48.08% | 0.016995833 | 1.25 |
| hCV589914 | yes | Replication, All Cases | Pool | All | G | 51.25% | 46.35% | 0.003743931 | 1.22 |
| hCV589914 | yes | Replication, Probands | Pool | All | G | 50.72% | 46.40% | 0.031290456 | 1.19 |
| hCV589914 | yes | Replication, All Cases | Pool | RF+ | G | 52.47% | 45.81% | 0.000489735 | 1.31 |
| hCV589914 | yes | Replication, Probands | Pool | RF+ | G | 51.35% | 45.81% | 0.015064359 | 1.25 |
| hCV3274630 | yes | Discovery | Pool | All | A | 42.72% | 49.36% | 0.00376044 | 0.77 |
| hCV3274630 | yes | Replication, All Cases | Individual | All | A | 45.76% | 50.38% | 0.006264619 | 0.83 |
| hCV3274630 | yes | Replication, Probands | Individual | All | A | 45.25% | 50.38% | 0.011192048 | 0.81 |
| hCV3274630 | yes | Replication, All Cases | Individual | RF+ | A | 44.29% | 50.78% | 0.000514166 | 0.77 |
| hCV3274630 | yes | Replication, Probands | Individual | RF+ | A | 43.90% | 50.78% | 0.001982975 | 0.76 |
| hCV25627998 | yes | Discovery | Pool | All | T | 0.92% | 0.17% | 0.038080194 | 5.49 |
| hCV25627998 | yes | Replication, All Cases | Pool | All | T | 1.33% | 0.55% | 0.019829797 | 2.43 |
| hCV25627998 | yes | Replication, Probands | Pool | All | T | 1.34% | 0.56% | 0.041259124 | 2.41 |
| hCV11600233 | yes | Discovery | Pool | HR-2SE | T | 59.49% | 43.04% | 0.000485016 | 1.94 |
| hCV11600233 | yes | Replication, All Cases | Pool | HR-2SE | T | 61.09% | 50.16% | 0.00077991 | 1.56 |
| hCV11690571 | yes | Discovery | Pool | All | G | 94.84% | 92.18% | 0.024895104 | 1.56 |
| hCV11690571 | yes | Replication, All Cases | Pool | All | G | 95.02% | 92.69% | 0.005138991 | 1.51 |
| hCV11690571 | yes | Replication, Probands | Pool | All | G | 95.21% | 92.92% | 0.024265047 | 1.51 |
| hCV11690571 | yes | Replication, All Cases | Pool | RF+ | G | 95.48% | 93.16% | 0.011792415 | 1.55 |
| hCV11690571 | yes | Replication, Probands | Pool | RF+ | G | 95.95% | 93.16% | 0.006516882 | 1.74 |
| hCV12055895 | yes | Discovery | Pool | All | T | 89.01% | 84.70% | 0.006453778 | 1.46 |
| hCV12055895 | yes | Replication, All Cases | Pool | All | T | 86.23% | 82.62% | 0.003006586 | 1.32 |

TABLE 6-continued

| Marker | Typed in Discovery and Replication? | Study | Genotyping | Stratum | Allele 1 | Case Freq | Control Freq | Allelic p-value | Odds Ratio |
|---|---|---|---|---|---|---|---|---|---|
| hCV12055895 | yes | Replication, Probands | Pool | All | T | 85.85% | 82.52% | 0.028283202 | 1.29 |
| hCV12055895 | yes | Replication, All Cases | Pool | RF+ | T | 86.26% | 82.23% | 0.003752911 | 1.36 |
| hCV12055895 | yes | Replication, Probands | Pool | RF+ | T | 86.30% | 82.23% | 0.014601385 | 1.36 |
| hCV12064788 | yes | Discovery | Pool | All | G | 91.94% | 87.50% | 0.001531213 | 1.63 |
| hCV12064788 | yes | Replication, All Cases | Pool | All | G | 93.50% | 87.35% | 6.00139E-10 | 2.08 |
| hCV12064788 | yes | Replication, Probands | Pool | All | G | 93.50% | 87.29% | 3.34024E-07 | 2.09 |
| hCV12064788 | yes | Replication, All Cases | Pool | RF+ | G | 94.22% | 87.59% | 1.73651E-09 | 2.31 |
| hCV12064788 | yes | Replication, Probands | Pool | RF+ | G | 93.89% | 87.59% | 1.41069E-06 | 2.18 |
| hCV1468814 | yes | Discovery | Pool | Male | T | 87.97% | 79.61% | 0.004031757 | 1.87 |
| hCV1468814 | yes | Replication, All Cases | Pool | Male | T | 87.48% | 80.67% | 0.017542901 | 1.67 |
| hCV1468814 | yes | Replication, Probands | Pool | Male | T | 89.06% | 80.67% | 0.027009572 | 1.95 |
| hCV15852026 | yes | Discovery | Pool | All | G | 88.30% | 85.13% | 0.042753162 | 1.32 |
| hCV15852026 | yes | Replication, All Cases | Pool | All | G | 89.94% | 86.49% | 0.001749278 | 1.40 |
| hCV15852026 | yes | Replication, All Cases | Pool | RF+ | G | 90.34% | 87.79% | 0.034437583 | 1.30 |
| hCV15941749 | yes | Discovery | Pool | All | T | 36.11% | 40.60% | 0.047505446 | 0.83 |
| hCV15941749 | yes | Replication, All Cases | Pool | All | T | 36.15% | 42.53% | 9.86493E-05 | 0.77 |
| hCV15941749 | yes | Replication, Probands | Pool | All | T | 33.86% | 42.59% | 1.07647E-05 | 0.69 |
| hCV15941749 | yes | Replication, All Cases | Pool | RF+ | T | 36.06% | 42.50% | 0.000490082 | 0.76 |
| hCV15941749 | yes | Replication, Probands | Pool | RF* | T | 34.33% | 42.50% | 0.000150358 | 0.71 |
| hCV16006934 | yes | Discovery | Pool | All | A | 20.70% | 17.08% | 0.046211396 | 1.27 |
| hCV16006934 | yes | Replication, All Cases | Pool | All | A | 24.05% | 20.41% | 0.009436009 | 1.23 |
| hCV16006934 | yes | Replication, All Cases | Pool | RF+ | A | 24.05% | 20.81% | 0.040570497 | 1.21 |
| hCV16023642 | yes | Discovery | Pool | All | T | 93.53% | 96.55% | 0.004062535 | 0.52 |
| hCV16023642 | yes | Replication, All Cases | Pool | All | T | 92.61% | 94.42% | 0.028086446 | 0.74 |
| hCV16023642 | yes | Replication, Probands | Pool | All | T | 91.59% | 94.32% | 0.006806874 | 0.66 |
| hCV16023642 | yes | Replication, Probands | Pool | RF+ | T | 91.52% | 94.19% | 0.016978699 | 0.67 |
| hCV2153710 | yes | Discovery | Pool | All | G | 70.58% | 78.27% | 0.000122531 | 0.67 |
| hCV2153710 | yes | Replication, All Cases | Pool | All | G | 74.85% | 79.18% | 0.002308953 | 0.78 |
| hCV2153710 | yes | Replication, Probands | Pool | All | G | 73.95% | 79.15% | 0.00258196 | 0.75 |
| hCV2153710 | yes | Replication, All Cases | Pool | RF+ | G | 74.77% | 79.94% | 0.001252083 | 0.74 |
| hCV2153710 | yes | Replication, Probands | Pool | RF+ | G | 74.85% | 79.94% | 0.005412316 | 0.75 |
| hCV216064 | yes | Discovery | Pool | All | G | 24.12% | 31.35% | 0.000486751 | 0.70 |
| hCV216064 | yes | Replication, All Cases | Individual | All | G | 24.79% | 28.55% | 0.011959926 | 0.83 |
| hCV216064 | yes | Replication, Probands | Individual | All | G | 24.62% | 28.55% | 0.029922943 | 0.82 |
| hCV216064 | yes | Replication, All Cases | Individual | RF+ | G | 23.85% | 28.29% | 0.007499249 | 0.79 |
| hCV216064 | yes | Replication, Probands | Individual | RF+ | G | 23.12% | 28.29% | 0.008053711 | 0.76 |
| hCV2250399 | yes | Discovery | Pool | male | A | 41.98% | 30.06% | 0.00184943 | 1.68 |
| hCV2250399 | yes | Replication, All Cases | Individual | male | A | 45.03% | 32.95% | 0.000874184 | 1.67 |
| hCV2250399 | yes | Replication, Probands | Individual | male | A | 47.73% | 32.95% | 0.001196062 | 1.86 |
| hCV2259574 | yes | Discovery | Pool | Male | T | 18.24% | 25.01% | 0.036181592 | 0.67 |
| hCV2259574 | yes | Replication, All Cases | Pool | Male | T | 18.69% | 26.36% | 0.023141099 | 0.64 |
| hCV2259574 | yes | Replication, Probands | Pool | Male | T | 15.27% | 26.36% | 0.005356738 | 0.50 |
| hCV25972265 | yes | Discovery | Pool | Onset 38-55 | A | 25.11% | 19.27% | 0.026638525 | 1.40 |
| hCV25972265 | yes | Replication, All Cases | Individual | Onset 38-55 | A | 22.92% | 18.38% | 0.025578056 | 1.32 |
| hCV25972265 | yes | Discovery | Pool | HR-2SE | A | 26.34% | 17.94% | 0.031262995 | 1.64 |
| hCV25972265 | yes | Replication, All Cases | Individual | HR-2SE | A | 24.13% | 19.06% | 0.02140711 | 1.35 |
| hCV25972265 | yes | Replication, Probands | Individual | HR-2SE | A | 24.61% | 19.06% | 0.03120769 | 1.39 |
| hCV3277068 | yes | Discovery | Pool | All | T | 32.39% | 28.06% | 0.045717416 | 1.23 |
| hCV3277068 | yes | Replication, All Cases | Pool | All | T | 34.97% | 29.69% | 0.00079947 | 1.27 |
| hCV3277068 | yes | Replication, Probands | Pool | All | T | 35.10% | 29.51% | 0.003379771 | 1.29 |
| hCV3277068 | yes | Replication, All Cases | Pool | RF+ | T | 35.39% | 29.32% | 0.000563192 | 1.32 |
| hCV3277068 | yes | Replication, Probands | Pool | RF+ | T | 36.22% | 29.32% | 0.000883004 | 1.37 |
| hCV478645 | yes | Discovery | Pool | All | C | 41.92% | 47.06% | 0.023811653 | 0.81 |
| hCV478645 | yes | Replication, All Cases | Pool | RF+ | C | 43.41% | 47.40% | 0.036510196 | 0.85 |
| hCV8844728 | yes | Discovery | Pool | All | G | 0.26% | 1.22% | 0.020812078 | 0.21 |
| hCV8844728 | yes | Replication, All Cases | Pool | All | G | 0.37% | 1.14% | 0.010606669 | 0.32 |
| hCV8870139 | yes | Discovery | Pool | All | T | 27.45% | 22.10% | 0.006775991 | 1.33 |
| hCV8870139 | yes | Replication, All Cases | Individual | All | T | 38.04% | 34.27% | 0.020574439 | 1.18 |
| hCV9484175 | yes | Discovery | Pool | All | T | 49.64% | 56.48% | 0.002825824 | 0.76 |
| hCV9484175 | yes | Replication, All Cases | Pool | All | T | 59.41% | 63.85% | 0.007604773 | 0.83 |
| hCV9484175 | yes | Replication, All Cases | Pool | RF+ | T | 58.68% | 63.73% | 0.007262101 | 0.81 |
| hCV2995653 | no | Discovery | Pool | All | G | 3.67% | 6.19% | 0.011215026 | 0.58 |
| hCV3293876 | no | Discovery | Pool | All | T | 7.99% | 13.68% | 6.52139E-05 | 0.55 |
| hCV25755336 | no | Discovery | Pool | All | G | 21.35% | 16.29% | 0.004889825 | 1.40 |
| hCV11688904 | no | Discovery | Pool | All | G | 0.82% | 2.50% | 0.004237938 | 0.32 |
| hCV25742456 | no | Discovery | Pool | All | G | 93.95% | 96.65% | 0.008820847 | 0.54 |
| hCV549896 | no | Discovery | Pool | All | G | 99.06% | 97.12% | 0.002342088 | 3.13 |
| hCV2479345 | no | Discovery | Pool | All | G | 42.52% | 48.52% | 0.008695748 | 0.78 |
| hCV11407883 | no | Discovery | Pool | All | G | 41.73% | 46.38% | 0.041993034 | 0.83 |
| hCV25926376 | no | Discovery | Pool | All | G | 62.23% | 67.50% | 0.016378471 | 0.79 |
| hCV2438322 | no | Discovery | Pool | All | T | 22.54% | 18.77% | 0.04149316 | 1.26 |
| hCV2455742 | no | Discovery | Pool | All | T | 51.99% | 62.58% | 4.31627E-06 | 0.65 |
| hCV2495658 | no | Discovery | Pool | All | T | 84.11% | 77.95% | 0.000560178 | 1.50 |
| hCV25745992 | no | Discovery | Pool | All | T | 2.16% | 3.79% | 0.040972564 | 0.56 |
| hCV25654189 | no | Discovery | Pool | All | G | 0.69% | 1.77% | 0.042040535 | 0.38 |

TABLE 6-continued

| Marker | Typed in Discovery and Replication? | Study | Genotyping Stratum | | Allele 1 | Case Freq | Control Freq | Allelic p-value | Odds Ratio |
|---|---|---|---|---|---|---|---|---|---|
| hCV25932834 | no | Discovery | Pool | All | G | 18.87% | 14.06% | 0.00643918 | 1.42 |
| hCV2438216 | no | Discovery | Pool | All | G | 70.76% | 75.70% | 0.014991722 | 0.78 |
| hCV25771405 | no | Discovery | Pool | All | T | 99.21% | 98.25% | 0.042040535 | 2.25 |
| hCV11976644 | no | Discovery | Pool | All | C | 10.49% | 5.40% | 2.99785E−05 | 2.05 |
| hCV8848880 | no | Discovery | Pool | All | A | 92.28% | 87.58% | 0.000589391 | 1.69 |
| hCV11976630 | no | Discovery | Pool | All | T | 49.63% | 57.00% | 0.001280773 | 0.74 |
| hCV11976652 | no | Discovery | Pool | All | G | 91.82% | 87.68% | 0.003201827 | 1.58 |
| hCV8848884 | no | Discovery | Pool | All | C | 95.93% | 93.47% | 0.024035986 | 1.65 |
| hCV16135464 | no | Discovery | Pool | All | T | 40.23% | 32.67% | 0.000601702 | 1.39 |
| hCV1545307 | no | Discovery | Pool | All | G | 98.26% | 96.58% | 0.01973113 | 2.00 |
| hCV3293859 | no | Discovery | Pool | All | G | 80.78% | 71.65% | 4.43295E−06 | 1.66 |
| hCV25953077 | no | Discovery | Pool | All | C | 84.46% | 78.31% | 0.000632511 | 1.51 |
| hCV11691237 | no | Discovery | Pool | All | T | 84.36% | 80.13% | 0.016520772 | 1.34 |
| hCV15867521 | no | Discovery | Pool | All | T | 9.28% | 3.93% | 2.79459E−06 | 2.50 |
| hCV11917903 | no | Discovery | Pool | All | G | 90.86% | 96.08% | 4.07917E−06 | 0.41 |
| hCV25654485 | no | Discovery | Pool | All | T | 2.03% | 5.04% | 0.000282044 | 0.39 |
| hCV11691179 | no | Discovery | Pool | All | G | 90.36% | 94.81% | 0.000215461 | 0.51 |
| hCV7469249 | no | Discovery | Pool | All | T | 91.00% | 86.39% | 0.00175466 | 1.59 |
| hCV11972291 | no | Discovery | Pool | All | G | 99.69% | 91.08% | 6.04968E−23 | 31.34 |
| hCV25996731 | no | Discovery | Pool | All | T | 27.35% | 21.57% | 0.003929944 | 1.37 |
| hCV25958453 | no | Discovery | Pool | All | G | 88.73% | 92.27% | 0.009574728 | 0.66 |
| hCV2437234 | no | Discovery | Pool | All | A | 69.82% | 74.89% | 0.013933548 | 0.78 |
| hCV8942480 | no | Discovery | Pool | All | G | 94.01% | 96.18% | 0.032944592 | 0.62 |
| hCV11681250 | no | Discovery | Pool | All | G | 38.58% | 46.30% | 0.000708847 | 0.73 |
| hCV11195029 | no | Discovery | Pool | All | G | 28.33% | 23.87% | 0.028405891 | 1.26 |
| hCV2978734 | no | Discovery | Pool | All | G | 74.20% | 69.80% | 0.036126242 | 1.24 |
| hCV15888165 | no | Discovery | Pool | All | T | 99.20% | 98.03% | 0.034459004 | 2.50 |
| hCV25474376 | no | Discovery | Pool | All | G | 72.84% | 78.59% | 0.003825161 | 0.73 |
| hCV2986466 | no | Discovery | Pool | All | G | 92.89% | 89.05% | 0.004007103 | 1.61 |
| hCV16135142 | no | Discovery | Pool | All | G | 73.32% | 78.80% | 0.00603893 | 0.74 |
| hCV25606044 | no | Discovery | Pool | All | T | 13.72% | 10.55% | 0.035135266 | 1.35 |
| hCV25953007 | no | Discovery | Pool | All | T | 2.93% | 4.84% | 0.033393769 | 0.59 |
| hCV11159941 | no | Discovery | Pool | All | T | 97.44% | 95.76% | 0.042779017 | 1.69 |
| hCV25984541 | no | Discovery | Pool | All | A | 9.55% | 12.92% | 0.02429628 | 0.71 |
| hCV25922909 | no | Discovery | Pool | All | T | 99.93% | 97.98% | 1.93164E−05 | 29.33 |
| hCV7514692 | no | Discovery | Pool | All | G | 21.77% | 27.48% | 0.004741751 | 0.73 |
| hCV15874455 | no | Discovery | Pool | All | T | 5.27% | 7.92% | 0.026009759 | 0.65 |
| hCV15876778 | no | Discovery | Pool | All | T | 20.62% | 14.77% | 0.000759591 | 1.50 |
| hCV25630844 | no | Discovery | Pool | All | T | 19.38% | 13.68% | 0.001039291 | 1.52 |
| hCV25630843 | no | Discovery | Pool | All | T | 19.72% | 14.80% | 0.005261751 | 1.41 |
| hCV25630845 | no | Discovery | Pool | All | G | 80.80% | 85.27% | 0.010285352 | 0.73 |
| hCV3233692 | no | Discovery | Pool | All | G | 77.92% | 85.34% | 2.54815E−05 | 0.61 |
| hCV3052660 | no | Discovery | Pool | All | G | 96.00% | 93.64% | 0.022783838 | 1.63 |
| hCV7513726 | no | Discovery | Pool | All | T | 15.39% | 9.54% | 0.000131463 | 1.72 |
| hCV163035 | no | Discovery | Pool | All | T | 64.80% | 69.68% | 0.027764206 | 0.80 |

SEQUENCE LISTING (50231 sequences)

SEQ ID NO: 1 - DNA, 7239 bp, Homo sapiens
  misc_feature (1)...(7239): n = A,T,C or G, or insertion/deletion polymorphism (see Tables 1-2)
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagargatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctnaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcgsaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttstggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctancctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagca

SEQ ID NO: 2 - DNA, 5179 bp, Homo sapiens
  misc_feature (1)...(5179): n = A,T,C or G, or insertion/deletion polymorphism (see Tables 1-2)
tgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaaraaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgckattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcarcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaangagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattmatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactsartgarcaaggcmtcttrgacaarytgaaaaacaaatggtggtacgayaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcrtaatttgcatgtgtgggcataaactacagagcctcattgccatgaggtattgtacaaagttttaatacattttgtaaataaaattgt

SEQ ID NO: 3 - DNA, 4967 bp, Homo sapiens
  misc_feature (1)...(4967): n = A,T,C or G, or insertion/deletion polymorphism (see Tables 1-2)
cgctttggcaaacccagcttgcagccaatgaacccgccttccagattggtgtgaagacagaagtgagcttcgttttaggcgtagcatggccaggcagaaraaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgckattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcarcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaangagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattmatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaaatgctgttaacctggcagtattaaaactsartgarcaaggcmtcttrgacaarytgaaaaacaaatggtggtacgayaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcrtaatttgcatgtgtgggcataaactacagagcctcattgccatgaggtattgtacaaagttttaatacattttgtaaataaaattgt

SEQ ID NO: 4 - DNA, 5179 bp, Homo sapiens
  misc_feature (1)...(5179): n = A,T,C or G, or insertion/deletion polymorphism (see Tables 1-2)
tgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaaraaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgckattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcarcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaangagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattmatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaagaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcrtaatttgcatgtgtgggcataaactacagagcctcattgccatgaggtattgtacaaagttttaatacattttgtaaataaaattgt

SEQ ID NO: 5 - DNA, 1541 bp, Homo sapiens
atggagtttcttgggactactcagaccgccagttactgtggtcccaagaaatgctgtggcttgacctcactgccagctrtacaggcgccagtgatccaggaatgctatcagccctactacctgcccgggtaccgctacctcaattcatggaggcctagcctcttctacaagatagccaacgtccagacctgcccggacgagagcaccagtaccctgcggccgcccaccatcctgcccacactgcgctccgcactcttctctcgctatagcccccacgactgggaccagtccaaccagctgcaggtgcgtggggccgaggcctccmggctgtgggccagccggctgacggatgactccatgaggctcttgcaggacaaggaccagctgacgcaccagatgcaggagggcacctgccggaacctgggccagaggctgtcggacattggcttctggaagtcagagctgagctatgagctggacagscttctgactgagaaccagaacttggagacggtcaagaggcggctggagtgcgcggccaatgaggtgaactgcccattgcaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattsayggcacgatctccgtacctgagacctgggccaagttcagtaacgacaacatcaaacactctcagaacatgcgggccaactccatccrgctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgcyggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaag

SEQ ID NO: 6 - DNA, 2058 bp, Homo sapiens
gttacttttttactgataatgtgaaagaatgatataaaaacttgattttcctcaacaacattactttcttttgtaaatrtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcwwctgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccrttacgcggaagacaaattcaatgagwcaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagtt

SEQ ID NO: 7 - DNA, 1644 bp, Homo sapiens
  misc_feature (1)...(1644): n = A,T,C or G, or insertion/deletion polymorphism (see Tables 1-2)
tgcagagcgcacgcgcttggctgcctggcgactgcacaagcagggatggcgtcgcttcagcgttctcgggtgctacgctgctgcagctgycgcctcttccaggcgcaccaggtaaaaaagagtgtcaagtggacatgcaaagcttgtggagagaagcagtcctttttgcgggcttatggtgaaggctctggtgctgattgtagacgccatgtccaaaagttaaatctactacagggacaagtttcagagctgccactcaggtctctagaagaaactgtcagtgccagtgaagaagaaaacgtgggacaccagcaggctgggaatgtgaagcagcaggaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaaaaaggaagtggagcnggagcaccgtccagcctccgtgcagccgtggcgtgcaggactcgggtggytctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcnatttgtcctgccacctagaaaaagttcacatgtggayagtgagcagccaaggtctcttcagaggraccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggyaggttattaatcgagatacacttgttaggagggacagggttcccctaaggcacttttaaagatactctgtaagaaccattaacaataaacttactgtcaatcatttctctctatgcaaacrtcattggttaaagtgctgatgccatttaattagattgtttacaaatttaacaggatggctacaaagagatcttattttaaaagcagctgatggtttggaaatgaragaactacagtggtgaagrgmccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggc

SEQ ID NO: 8 - DNA, 1568 bp, Homo sapiens
  misc_feature (1)...(1568): n = A,T,C or G, or insertion/deletion polymorphism (see Tables 1-2)
tgcagagcgcacgcgcttggctgcctggcgactgcacaagcagggatggcgtcgcttcagcgttctcgggtgctacgctgctgcagctgycgcctcttccaggcgcaccaggtaaaaaagagtgtcaagtggacatgcaaagcttgtggagagaagcagtcctttttgcgggcttatggtgaaggctctggtgctgattgtagacgccatgtccaaaagttaaatctactacagggacaagtttcagagctgccactcaggaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaaaaaggaagtggagcnggagcaccgtccagcctccgtgcagccgtggcgtgcaggactcgggtggytctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcnatttgtcctgccacctagaaaaagttcacatgtggayagtgagcagccaaggtctcttcagaggraccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggyaggttattaatcgagatacacttgttaggagggacagggttcccctaaggcacttttaaagatactctgtaagaaccattaacaataaacttactgtcaatcatttctctctatgcaaacrtcattggttaaagtgctgatgccatttaattagattgtttacaaatttaacaggatggctacaaagagatcttattttaaaagcagctgatggtttggaaatgaragaactacagtggtgaagrgmccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggc

SEQ ID NO: 9 - DNA, 1308 bp, Homo sapiens
  misc_feature (1)...(1308): n = A,T,C or G, or insertion/deletion polymorphism (see Tables 1-2)
gaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaaaaaggaagtggagcnggagcaccgtccagcctccgtgcagccgtggcgtgcaggactcgggtggytctgaggtcgcctggggaccccagaagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcnatttgtcctgccacctagaaaaagttcacatgtggayagtgagcagccaaggtctcttcagaggraccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggyaggttattaatcgagatacacttgttaggagggacagggttcccctaaggcacttttaaagatactctgtaagaaccattaacaataaacttactgtcaatcatttctctctatgcaaacrtcattggttaaagtgctgatgccatttaattagattgtttacaaatttaacaggatggctacaaagagatcttattttaaaagcagctgatggtttggaaatgaragaactacagtggtgaagrgmccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggc

SEQ ID NO: 10 - DNA, 830 bp, Homo sapiens
  misc_feature (1)...(830): n = A,T,C or G, or insertion/deletion polymorphism (see Tables 1-2)
aaaggactcccaagaactggagctggaaggaacaggagtgtgtttcagcaaacagccttcatccaaaatggaggagccaggcccccgcttcagtcaagacctgcctagaaaaaggaagtggagcnggagcaccgtccagcctccgtgcagccgtggcgtgcaggactcgggtggytctgaggtcgcctggggaccccagaagggacaggctggcctgacatggaaggtgaaacaagcagcagcccctgccttcaggagaactctgcagactgcagtgccggggagctgaggggtcctgggaaggagctatggagtcccatccagcaggttacagccacatcctctaaatgggcgcnatttgtcctgccacctagaaaaagttcacatgtggayagtgagcagccaaggtctcttcagaggraccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggyaggttattaatcgagatacacttgttaggagggacagggttcccctaaggcacttttaaagatactctgtaagaaccattaacaataaacttactgtcaatcaaaaaaaaaaaaaaaaaaaa

SEQ ID NO: 11 - DNA, 2985 bp, Homo sapiens
  misc_feature (1)...(2985): n = A,T,C or G, or insertion/deletion polymorphism (see Tables 1-2)
agagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggyttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagasagttccagcacagaggagaagagcagctcacagccaagcagctgctgctctgancccagcaagccgggtgggaatgttgagggygccacgcagtctctggcggagcagatgagnaagatcgccttggagtcyraggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacnggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggkcycttcaccactgtagttctytcatttccaaaccatcagctgcttttaaaataagatctctttgtagccatcctgttaaatttgtaaacaatctaattaaatggcatcagcactttaaccaatgaygtttgcatagagagaaatgattgacagtaagtttattgttaatggttcttacagagtatctttaaaagtgccttaggggaaccctgtccctcctaacaagtgtatctcgattaataacctrccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtycctctgaagagaccttggctgctcactrtccacatgtgaactttttctaggtggcaggacaaatngcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatntgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgc

SEQ ID NO: 12 - DNA, 2920 bp, Homo sapiens
  misc_feature (1)...(2920): n = A,T,C or G, or insertion/deletion polymorphism (see Tables 1-2)
cgcctgcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggyttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagasagttccagcacagaggagaagagcagctcacagccaagcagctgctgctctgancccagcaagccgggtgggaatgttgagggygccacgcagtctctggcggagcagatgagnaagatcgccttggagtcyraggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacnggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggkcycttcaccactgtagttctytcatttccaaaccatcagctgcttttaaaataagatctctttgtagccatcctgttaaatttgtaaacaatctaattaaatggcatcagcactttaaccaatgaygtttgcatagagagaaatgattgacagtaagtttattgttaatggttcttacagagtatctttaaaagtgccttaggggaaccctgtccctcctaacaagtgtatctcgattaataacctrccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtycctctgaagagaccttggctgctcactrtccacatgtgaactttttctaggtggcaggacaaatngcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatntgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgc

SEQ ID NO: 13 - DNA, 2870 bp, Homo sapiens
  misc_feature (1)...(2870): n = A,T,C or G, or insertion/deletion polymorphism (see Tables 1-2)
ggcctgggtggcgaattcggcacgaggctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggyttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagasagttccagcacagaggagaagagcagctcacagccaagcagctgctgctctgancccagcaagccgggtgggaatgttgagggygccacgcagtctctggcggagcagatgagnaagatcgccttggagtcyraggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacnggccagtttctctgccttcttccaggatcaggggttagggtgcaagaagccatttagggcagcaaaacaagtgacatgaagggagggtccctgtgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggmcrcttcaccactgtagttctrtcatttccaaaccatcagctgcttttaaaataagatctctttgtagccatcctgttaaatttgtaaacaatctaattaaatggcatcagcactttaaccaatgargtttgcatagagagaaatgattgacagtaagtttattgttaatggttcttacagagtatctttaaaagtgccttaggggaaccctgtccctcctaacaagtgtatctcgattaataacctyccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtrcctctgaagagaccttggctgctcactytccacatgtgaactttttctaggtggcaggacaaatngcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatntgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaaaaaaaaaaaaaaaaaaaaa

SEQ ID NO: 14 - DNA, 1535 bp, Homo sapiens
  misc_feature (1)...(1535): n = A,T,C or G, or insertion/deletion polymorphism (see Tables 1-2)
gcgggtgtttgtcgcttcgcggggccttgcggcagcatggcgnaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcratggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatgggsagcaagttggtgggcatcatctcctcccgagacatcaactttcttgctgagaaggaccacaccaccctcctcagtgaggtgatgacgccaaggatcaagctgatggtggctccagcaggcatgacattgaaasaggcaaatgagatccttcagcctagcargggaagctgcctytggtcaatgatcgccatgagctagtggccatcgtctcccacaccaacctgaagaagaatcgagactacattctggcctycaaggattcccacaagcagctgctgtgcagggcagctgtgggcacccatgaggatgamaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgaytgacactggtgtggatggactgcatgtagttatgggctrcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcrgcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcagragagctcaaatttgagaagtggaccatgtcagcccagatcgagggtggcgtccatggcctgcacgcttaccagaagcagctgtac

SEQ ID NO: 15 - DNA, 1555 bp, Homo sapiens
cgcacccacccggactcagaatctcctcagacgccgagatgckggtcayggmrccccgaaccgtcctcctgctgctctsggsrgcmstggccctgaccgagacctgggcbggctcccactccatgaggyatttcbacacckccrtgtcccggcccggccgcggggagccccgcttcatydcmgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggyayvaccagghcgcctacgacggcaargattacatcgccctgaacgaggacctgmgctcctggaccgcsgcggacacsgcggctcagatcwcccagcgcaagtgggaggcggcccgtgwggcggagcagykgagarcctacctggagggcvhgtgcgtggabksgctccgcagryacctggagaacgggaaggasamgctgsagcgcgckgaccccccdaagacacaygtgacccaccaccccrtctctgaccatgaggycaccctgaggtgctgggccctgggyttctaccctgsggagatcacactgacctggcagcgggatggcgaggaccaaactcaggacacygagcttgtggagaccagrccagcaggagayrgaaccttccagaagtggrcagctgtggtggtgcyttctggasaagarcagagatacacrtgccatgtrcagcaygaggggctgcmrragcccykcaccctgagatggragccrtcttcccartccaccrtccccatygtgggcattgttgctggcctggctgtcctwkymrttgtggtyrtsgkmgctgtggtygctrctgtgrtgtgtaggaggaagagytcwggtggaaaaggagggagctactctcaggctgcgtgcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtycctgttagcmtaatgtgaggaggtggagagacagcccamccyygtgtccacygtgacccctgttcccatgctgayytgtgtttcctccccagtcatctttcytgttccagagrggtggggctggatgtctccatctctgtctcaactttayrtgcactgagctgcaacttcttacttccctrctgaaaataagaatctgaatataaatttgttttctcaaatatttgctatgagaggttgatggattaattaaataagtcaattcctggaatktgaragagcaaataaagacctgagaaccttccaga

SEQ ID NO: 16 - DNA, 2195 bp, Homo sapiens
cgcacccacccggactcagaatctcctcagacgccgagatgckggtcayggmrccccgaaccgtcctcctgctgctctsggsrgcmstggccctgaccgagacctgggcbggctcccactccatgaggyatttcbacacckccrtgtcccggcccggccgcggggagccccgcttcatydcmgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggyayvaccagghcgcctacgacggcaargattacatcgccctgaacgaggacctgmgctcctggaccgcsgcggacacsgcggctcagatcwcccagcgcaagtgggaggcggcccgtgwggcggagcagykgagarcctacctggagggcvhgtgcgtggabksgctccgcagryacctggagaacgggaaggasamgctgsagcgcgckgaccccccdaagacacaygtgacccaccaccccrtctctgaccatgaggycaccctgaggtgctgggccctgggyttctaccctgsggagatcacactgacctggcagcgggatggcgaggaccaaactcaggacacygagcttgtggagaccagrccagcaggagayrgaaccttccagaagtggrcagctgtggtggtgcyttctggasaagarcagagatacacrtgccatgtrcagcaygaggggctgcmrragcccykcaccctgagatggrgtaaggagggggatgaggggtcatatctsttctcagggaaagcaggagcccttcagcagggtcagggcccctcrtcttcccytcctttcccagagccrtcttcccartccaccrtccccatygtgggcattgttgctggcctggctgtcctwkymrttgtggtyrtsgkmgctgtggtygctrctgtgrtgtgtaggaggaagagytcwggtagggaaggggtgaggggtggggtytgrgttttcttgtcccactgggggtttcaagccccaggtagaagtgttccctgcmtcattactgggawgcagcatscacacaggggctaacgcagcctgggaccctgtgtgccagcacttactcttttgtgcagcacatgtgacaatgaaggayggatgtatcaccttgrtggttgtggtgttggggtcctgattccagcattcatgagtcaggggaaggtccctgctaaggacagaccttaggagggcagttggtccaggacccacacttgctttcctcgtgtttcctgatcctgccytgggtctgtagtcatacttctggaaattccttttgggtccaagacgaggaggttcctctaagatctcatggccctgcttcctcccagtsccctcacagggcattttcttcccacaggtggaaaaggagggagctactctcaggctgcgtgtaagtgrtgggggygggagtgtggaggagctcacccaccccataattcctcctgtcccacgtctcctgcgggctctgaccaggtcctgtttttgttctactccaggcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtycctgttagcmtaatgtgaggaggtggagagacagcccamccyygtgtccacygtgacccctgttcccatgctgayytgtgtttcctccccagtcatctttcytgttccagagrggtggggctggatgtctccatctctgtctcaactttayrtgcactgagctgcaacttcttacttccctrctgaaaataagaatctgaatataaatttgttttctcaaatatttgctatgagaggttgatggattaattaaataagtcaattcctggaatktgaragagcaaataaagacctgagaaccttccaga

SEQ ID NO: 17 - DNA, 1795 bp, Homo sapiens
cgcacccacccggactcagaatctcctcagacgccgagatgckggtcayggmrccccgaaccgtcctcctgctgctctsggsrgcmstggccctgaccgagacctgggcbggctcccactccatgaggyatttcbacacckccrtgtcccggcccggccgcggggagccccgcttcatydcmgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccggtgagtgaccccggcccggggcgcaggtcacgactccccatcccccacggacggcccgggtcgccccgagtctccgggtccgagatccgcccccgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacatcatccagaggatgtacggctgcgacgtggggccggacgggcgcctcctccgcgggyayvaccagghcgcctacgacggcaargattacatcgccctgaacgaggacctgmgctcctggaccgcsgcggacacsgcggctcagatcwcccagcgcaagtgggaggcggcccgtgwggcggagcagykgagarcctacctggagggcvhgtgcgtggabksgctccgcagryacctggagaacgggaaggasamgctgsagcgcgckgaccccccdaagacacaygtgacccaccaccccrtctctgaccatgaggycaccctgaggtgctgggccctgggyttctaccctgsggagatcacactgacctggcagcgggatggcgaggaccaaactcaggacacygagcttgtggagaccagrccagcaggagayrgaaccttccagaagtggrcagctgtggtggtgcyttctggasaagarcagagatacacrtgccatgtrcagcaygaggggctgcmrragcccykcaccctgagatggragccrtcttcccartccaccrtccccatygtgggcattgttgctggcctggctgtcctwkymrttgtggtyrtsgkmgctgtggtygctrctgtgrtgtgtaggaggaagagytcwggtggaaaaggagggagctactctcaggctgcgtgcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtycctgttagcmtaatgtgaggaggtggagagacagcccamccyygtgtccacygtgacccctgttcccatgctgayytgtgtttcctccccagtcatctttcytgttccagagrggtggggctggatgtctccatctctgtctcaactttayrtgcactgagctgcaacttcttacttccctrctgaaaataagaatctgaatataaatttgttttctcaaatatttgctatgagaggttgatggattaattaaataagtcaattcctggaatktgaragagcaaataaagacctgagaaccttcc

SEQ ID NO: 18 - DNA, 1620 bp, Homo sapiens
cgcacccacccggactcagaatctcctcagacgccgagatgckggtcayggmrccccgaaccgtcctcctgctgctctsggsrgcmstggccctgaccgagacctgggcbggctcccactccatgaggyatttcbacacckccrtgtcccggcccggccgcggggagccccgcttcatydcmgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggyayvaccagghcgcctacgacggcaargattacatcgccctgaacgaggacctgmgctcctggaccgcsgcggacacsgcggctcagatcwcccagcgcaagtgggaggcggcccgtgwggcggagcagykgagarcctacctggagggcvhgtgcgtggabksgctccgcagryacctggagaacgggaaggasamgctgsagcgcgckgatcaggagcagaagtccctgttccccrctcagagactcgaactttccaatgaataggagattatcccagaccccccdaagacacaygtgacccaccaccccrtctctgaccatgaggycaccctgaggtgctgggccctgggyttctaccctgsggagatcacactgacctggcagcgggatggcgaggaccaaactcaggacacygagcttgtggagaccagrccagcaggagayrgaaccttccagaagtggrcagctgtggtggtgcyttctggasaagarcagagatacacrtgccatgtrcagcaygaggggctgcmrragcccykcaccctgagatggragccrtcttcccartccaccrtccccatygtgggcattgttgctggcctggctgtcctwkymrttgtggtyrtsgkmgctgtggtygctrctgtgrtgtgtaggaggaagagytcwggtggaaaaggagggagctactctcaggctgcgtgcagcgacagtgcccagggctctgatgtgtctctcacagcttgacctgagacagctgtcttgtgagggacygagatgcaggatttcttcackcctcccctttgtgacttcaagascctctggcatctctttctgcaaaggcacctgaatgtgtctgcgtycctgttagcmtaatgtgaggaggtggagagacagcccamccyygtgtccacygtgacccctgttcccatgctgayytgtgtttcctccccagtcatctttcytgttccagagrggtggggctggatgtctccatctctgtctcaactttayrtgcactgagctgcaacttcttacttccctrctgaaaataagaatctgaatataaatttgttttctcaaatatttgctatgagaggttgatggattaattaaataagtcaattcctggaatktgaragagcaaataaagacctgagaaccttccaga

SEQ ID NO: 19 - DNA, 2785 bp, Homo sapiens
ctctctcttccacctttcccaacctgtgtcaggtccttttacctggatactcatgatgcggcctcagttctcacttccattgggtgttgggttcctagatcagccaatcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtrcggggtcgggagggaaaargcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctgkggatcaggatctattacctgtgcctggagagraggggactcctcttctcacccgctggtctctggacacatactgtccaattcccctgkggcagctgtaatgtgtagttcaatgggcactcatttgtccccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggycagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttayacagatgctaattcktaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaa

SEQ ID NO: 20 - DNA, 2538 bp, Homo sapiens
actcagattctccccagacgccaaggttgcgggtcatggagtcccgaaccstcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctgkggatcaggatctattacctgtgcctggagagraggggactcctcttctcacccgctggtctctggacacatactgtccaattcccctgkggcagctgtaatgtgtagttcaatgggcactcatttgtccccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggycagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttayacagatgctaattcktaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaa

SEQ ID NO: 21 - DNA, 2535 bp, Homo sapiens
ggcccagacgccaaggttgcgggtcatggagtcccgaaccctcctcctgctgttctcgggagccgtggccctgatccagacctgggcagattacaattacaatcaaggcagaaatgatctcatttttacattacaactcctggaaaaggcaatagactgagatgcaagtgtgcccccaagtgatgggcagaaggagagaaggatgttttggatgcattctagaacacaggtaatctaaggagagttgatycaaggcacgtaggaagagtcctccagccactattaggccatcaaaggagtcctcatgtgtcccaggaaatggtcctgctttggtgtccctggtgtgacccatcacccgctggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggtccaaggatccctgggttccacacgaactcctcctaccctcattgtgtgacagcagccatgcctcctcctggggakcaggatctattacctgtgcctggagagraggggactcctcttctcacccgctggtctctggrcacatactgtccaattcccctgkggcagctgtaatgtgtagttcaatgggcactcatttgtcycttttaagggtaccctcctttagaatccaggaccttctaccctgcagagtgtgktttggggagagaagtgcaaaatcccacgacaggtgagttgaaggaatgggatatggagccacatccacttccaccccttggtatctggacccacgtgttcttcctactgagattacagaactgtagagatrtctttgatttttaaaatgcaccatgtcctgaaagatggcaccctcccacccgcaggagtgcttcctgcaagctggcgttgagctgtgcctatagaagctcttttcaacattctttatgytccsggagcccttggttggtgcagatggtgataggacccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccacctacccggcctgggctgaccatgggaaggctggctaatttcagtgcttgtgsttggttgttcagggccatttcaggtttgggtgttttctggggatgttaacatgggattcaggctcaactcacaagaaacttttcatctcatgatggatgctgttgggcatgtccaatgtatgacttcatgagttacycagatgctaattcgkaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttcttccttgcatgaggatgcaagatgcaacagtttgtcttcacattggaaggacacccctggatgcccctaaccactagacctgtaaaacttcactgcagtggccacttctgaatctctgtaaggtttatttatcttcacccctctggagagaagatgttttaccaaagcctctagtgtaccgtcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaaaaaaaaaa

SEQ ID NO: 22 - DNA, 5010 bp, Homo sapiens
  misc_feature (1)...(5010): n = A,T,C or G, or insertion/deletion polymorphism (see Tables 1-2)
cggtggcggctcccggccgggcctcggcgcctccgccgcccccgcccgtgtactgtgtgtgccggcagccgtacgacgtgaaccgcttcatgatcgagtgcgatatctgcaaggactggttccacggcagctgtgttggagtagaagaacatcatgctgttgacattgacctgtatcactgtcccaactgtgcagttttacatggttcctccttgatgaaaaaaaggaggaactggcacagacatgactacacagaaattgatgatggttccaaaccagtgcaagctggaactagaactttcattaaggaattacgctctcgagtcttcccaagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaangattagagatgtgtccatgggaagaggcaagtattatctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacamgtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatg

SEQ ID NO: 23 - DNA, 4779 bp, Homo sapiens
cggtggcggctcccggccgggcctcggcgcctccgccgcccccgcccgtgtactgtgtgtgccggcagccgtacgacgtgaaccgcttcatgatcgagtgcgatatctgcaaggactggttccacggcagctgtgttggagtagaagaacatcatgctgttgacattgacctgtatcactgtcccaactgtgcagttttacatggttcctccttgatgaaaaaaaggaggaactggcacagacatgactacacagaaattgatgatggttccaaaccagtgcaagctggaactagaactttcattaaggaattacgctctcgagtcttcccaagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacamgtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatg

SEQ ID NO: 24 - DNA, 1179 bp, Homo sapiens
tcagccctctgcctcctcctcaccaagccctcagacagctccaaggccccggctgctccaktgccacacagccgctgccacctctccttagcctccatgttgactacatcccccttgcaggataycaagaaaccatactgtaatgactgggagagcaggctgaatgcaatggagggtgyattacacttgataaaaaacatgaatcagtcactactggaactgcacaaactggccactgacaaaaatgaccaccactgtgttgacttcattgagacacattacctgaatgagcaagtgaaatccatcaaagaattgggtgaccatgtgaccaagtcacacaagcgtggttactgggattggcctgtccagaagcatcatgacccaygtaaggtagaggagatgtgcaaagccaatgagccctgcacaagctttgcaaagtgtgtgtgtgatgagaattgtgagaaggaagctctgtgcaagtggcttctgaagaaagaaggaaaggataaaaatgggatgcctgaggaacccaaacctgagcctgagaagcataaagattccctgaacatgtggttctgtccttctagaaaagaaagcttaagttactttgtacctctgagccccttcgcagaagtattgtattcttatacgctgatgataatttctaagaagccattggacacaatggaatcagcagattcccagcacccagccagagagctgatagaagaggagcttgaagaagcaacagtcggaggccagagaattctggcaagatggagctctgcgcctgagcccagctgcctcctcactggacgactatccatgtcccaagctacctctgtcatgagaagccctgcttctctctactctaaaccaccttacgaatatatcagcaacttcaaaaatgtaccaagaataccagttgtcataggggccttagtatcagctgctttggccttccagtggactggggacaggtctctcatcatatacctggctgtctgctgggctctttccagtctctcattaaatccctatcatgctggattggctctgagcattagtgaaaaaaacacttcctgttttcctgacaaagcagaacctagcacactgcccttgtgtgatgaatacttagcgattatcttagtgcaaccaagaggaaaaaaacaagggatt

SEQ ID NO: 25 - DNA, 1310 bp, Homo sapiens
atgtgggtggaacggggaagctggagcagatttttggaggaaagcaaaactggggactttcaggactaggggcctgggtctcagaagaatgggaaaggacgagaaaggagtctaaataagaaccctgctattagcattgtttggttttcttttcaggtgctgacctgaacctggttyatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaasgcttgagctggaagtaagcccagatccagccagccaaattctagagcatactcaaggagctgaaaaactggttgctgaacttgaaggagactctcataagtctcatggatcaaccagtcagatgccagagrcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaacccygaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtytgcgcaagatgtttggctgattaaaagttaaaccttaaaagagacaggaa

SEQ ID NO: 26 - DNA, 1338 bp, Homo sapiens
agtatctttcccagttgttccgccccctacccccgcctcccgcaccgcgcccctctccggctgccctctccgygtggggcaaggctccgagggcagcattcagtagccatttagctttggaaggagaggtgattcgaatggcccggctcctcctgtcaccatgcyaggcactttggccgygcaggtgctgacctgaacctggttyatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaasgcttgagctggaagtaagcccagatccagccagccaaattctagagcatactcaaggagctgaaaaactggttgctgaacttgaaggagactctcataagtctcatggatcaaccagtcagatgccagagrcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaacccygaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtytgcgcaagatgtttggctgattaaaagttaaaccttaaaagagacaggaa

SEQ ID NO: 27 - DNA, 402 bp, Homo sapiens
atgcggaagatgctggtttactggatgctggaggtgtgtgaggagcagtgctgtgaggaggagcagtgctgtaaggaggaagtctttcccctggccatgaaccacctgcatgctacctgtcctacgtccccacccacccgaaaggcacagttgcagctcttggttgcggtctccatgcsgctggcctccaagctgcgtaagactgggcccatgaccattgagaaaatgtgcatctacaccgaccacgctgtctctccctgccagttgcgggactgggaggccttggtcaaaaagcatgcccagatctttttggctgtctgtgctacagattacacctttgccatgtacccaccatccaagaggaaactgaagcctaattcagaattttcattggtagcattg

SEQ ID NO: 28 - DNA, 1050 bp, Homo sapiens
cagcaacttaagctaytatgatcctaattttacagatgaggaaaatgaggcacaaagaagtctgtctscgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctmaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaraattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattt

SEQ ID NO: 29 - DNA, 1268 bp, Homo sapiens
aagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagagacaaggatggagatctgaagactcaaattgaaaagctctggacagaagtcaatgccttgaaggaaattcaagccctgcagacagtctgtctscgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctmaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaraattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattt

SEQ ID NO: 30 - DNA, 2082 bp, Homo sapiens
  misc_feature (1)...(2082): n = A,T,C or G, or insertion/deletion polymorphism (see Tables 1-2)
attcatattcacccttcatgaggatgagcacagagcaagaagctagccacgctgggctcctcattgcctagctcaggaattcagggctgggaaaatttagccgagtcatcacatttggctactamccgggaaagcagccctcccgagtcaggaacgggctccggttcatcacgtggcagccgcctgcaggagccgcagtyccatggaccaaagacagaggagaatcctgggccagcccctttccatccctacttcccagcccaagcagaaaaggacatcaatgatatctttcttttccaaggtctcttggaaactgagsttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcrcccttcagaccaggactttattagatgangagaacracagtctgagatactcggcctttgttttgtttgggcaattggctgcctttgcygggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggagraatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagrtaactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgt

SEQ ID NO: 31 - DNA, 2108 bp, Homo sapiens
  misc_feature (1)...(2108): n = A,T,C or G, or insertion/deletion polymorphism (see Tables 1-2)
atttctgcagaaagtgtcgaccaggctggcatgagggaagaaggaggggaaatcacagcaaggagaaggaaaaacacctcagcatggcgtggggaagcaaaggaattcagggctgggaaaatttagccgagtcatcacatttggctactamccgggaaagcagccctcccgagtcaggaacgggctccggttcatcacgtggcagccgcctgcaggagccgcagtyccatggaccaaagacagaggagaatcctgggccagcccctttccatccctacttcccagcccaagcagaaaaggacatcaatgatatctttcttttccaaggtctcttggaaactgagsttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcrcccttcagaccaggactttattagatgangagaacracagtctgagatactcggcctttgttttgtttgggcaattggctgcctttgcygggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggagraatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagrtaactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgt

SEQ ID NO: 32 - DNA, 4446 bp, Homo sapiens
tctctcagtctctctccctgtcctccccggccgctcctccgagatgacgccggggtcggtgccccgggcctgccctctcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagmaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccmgagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccrgtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaakccagaaagctctgaggagaggccctataatttgggcttcaggagaaaggtcaatcttaaagcacccacccacaactcagaaaggccgccccaaggctcctacatgaatgtccttgaggaygcactggactstgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaayatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggttccaggggattcaagcaggaggtggtagggagggagctgggggccccagagcatcttcagctgctgttgggtggaggtggccgggacagggcygggcggcccctgcttctggtgtcaactacagagggggcctgggaggcaccatggtgcacagtttcagaggtcaccaagctactgtcctacctgtgtaccatccccaggcctgaagataaagccaaggggctggyggtcctgattgacgccaggagacagcccccacagcccrgtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccagrtgcctgagcaagtccaaggagctgatggaggctgtgctgagggacccsggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggmtragctgacccacttttacatggcrgccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatcyggatgctcctggagaaggcactgacccacagctcttgcccagaggctccagctgctcactcagcgcgcccagaaygaagaggggtggcagccaagggccagggtgtgagtgtagaggtcacttccaaggggaggtgggatcagcctccactagactcrctgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtygacctgcccctggctccagaaaactcctggaagacccgatcytcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagmaaa

SEQ ID NO: 33 - DNA, 4368 bp, Homo sapiens
tctctcagtctctctccctgtcctccccggccgctcctccgagatgacgccggggtcggtgccccgggcctgccctctcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagmaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccmgagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccrgtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaakccagaaagctctgaggagaggccctataatttgggcttcaggagaaaggtcaatcttaaagcacccacccacaactcagaaaggccgccccaaggctcctacatgaatgtccttgaggaygcactggactstgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaayatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggcygggcggcccctgcttctggtgtcaactacagagggggcctgggaggcaccatggtgcacagtttcagaggtcaccaagctactgtcctacctgtgtaccatccccaggcctgaagataaagccaaggggctggyggtcctgattgacgccaggagacagcccccacagcccrgtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccagrtgcctgagcaagtccaaggagctgatggaggctgtgctgagggacccsggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggmtragctgacccacttttacatggcrgccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatcyggatgctcctggagaaggcactgacccacagctcttgcccagaggctccagctgctcactcagcgcgcccagaaygaagaggggtggcagccaagggccagggtgtgagtgtagaggtcacttccaaggggaggtgggatcagcctccactagactcrctgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtygacctgcccctggctccagaaaactcctggaagacccgatcytcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagmaaa

SEQ ID NO: 34 - DNA, 1847 bp, Homo sapiens
ggggggctgtgctccaggcagggggcaaacacatgtgaaggccctgaggtgggattatacctggggtgttcaggagtagcaaggaggccagtgtggagcagaatgagtgggaaagaagcatgagtggagcttctagatgcagcaggagctggaccaaggaagagttgggctgggattcagttcgaagcctgcagggaaagccactggagagttttaaaccaggggttatcagatttgcactttgagatccgttcaactgccatgtggagaacagactgtagggggagccagagggcagcagggagatcagcgaagaggctggaatgggtgtcccagcaagagatgctggagggtggaccaatgaggttgccgtggtgaygagaggggacatggctagaggggatgttttagagacagaaatgacagactttctggaggaccttgaatgccaaactgggagttggacttgatctgggtgtggggagccttggaaggttgcagagggagagtggggatggggcctcagggcacctccctacgctggcaggaggctaccagrtgcctgagcaagtccaaggagctgatggaggctgtgctgagggacccsggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagtgcgttccagacaacagaggagcaggactggagcagatggagagggcgttagagggggtggcactgccagggcaaagctgtggaggtgggaaagagcaagaaaagttccagagacagtgagggaaccagcttggattgcagagttcagctgagatgttatctcccccagagattcttaccagatggccaagcccaaagaatattctgaatcccccagagggtttcttaaaatgcagtttccagggccccatcctagacctaataactcagcctcacagagccgggggttggagggcagggaagctgcatcaacgtgatgcgatgtgacaaggctctggaccacagggtgattcagccccgtatcagcgctcaggaattctcaggccagtggggagcgggggcgggggcggggacaaacagggaagcgcacagtaagggagaatgtggggactcagagcaggagcctttggagtcagagaagttttccagaaggaacatctaagcagagcccggctaggcaaagtgaactgccatggcgagggcctggagacttccagaagcgtgataactgctcttaattgttcaaccctcaccaggagctaagccctgtgaggtgggtgctattagggtccccattctacagatgaggaaactgaagctcaggaagtctcctggctcgccagcaaggcagctggaggttgctgacctccgagggaggccccagccaaggtgggtgctgagtgggcgccccctcctctcccctctcaggcccagtaccgccgaggcctggagctgtccaagcaggccgctcagctgggagctacagccagaggggctggggaggcagaacgtgcagagttcccagagctggcagcctttgcctctacc

SEQ ID NO: 35 - DNA, 1981 bp, Homo sapiens
  misc_feature (1)...(1981): n = A,T,C or G, or insertion/deletion polymorphism (see Tables 1-2)
gaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaatcatggcgtgaataatttctttcctctaccgatttgaagctatccatttggaagaccactctgaagagatgaaataagtcttctgccaaagattacttattaatttacaaggaaaaggggaagttttgttcctctccgtgaatttgattgaaaatcgagggctttctcgaatagttttggcatccagggtcatttttcattaaaaagagaaaagtcatgtcaaatatgaatttccgcagattattcagcactagaccctgggagattctgtaaagaggggttttgttatactcaacttttccgggtaaaacaaacacaaatactcctcctccaaggggcgggggcggtgcctaggtgatgcaccaatcacagcgcgccctaccctatataaggccccgaggccgyccgggtgtttcatgcttttcgctggttattacatcttgcgtttctctgttgttatgtctgaaaccgtgcctgcagcttctgccagtgctggtstagccgctatggagaaacttccaaccaagaarcgagggaggaagccggctggcttgataagtgcaagtcgcaaagtgcygaacctctctgtgtccaagttgatcaccgrggccntttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaartcagtttctgccaagaccaagaagctggttttatccagggactccaagtcaccaaagactgctaaaaccaataagagagccaagaagycgagagcgacaactcctaaaactgttaggagcgggwgaaaggctaaaggagccaagggtaagcaamagcagaagagcccagtgaaggcaagggcttcgaagtcaaaattgacccaacatcatgaagttaatgttagaaaggccacatctaagaagtaaagagctttccgggaggccaatttggaargaacccaaaggctcttttaagagccacccacattattttaagatggcgtaacactggaaacaagtttctgtgacagttatctataggtttaagttgtgatgcagctgagttgaaaaggcttgagattggagaattaattcaggccaggcttcaagaccatcctgggcaacatagccagactaccatctataccaggggtcctcattyccccggccaccgaccggtaaccggtccctgtccatggcacgttatgaattgagccgcacagctgaggggtgagcgaacattaaccaactgagctccaccgcctgtcaggttagctgcagcattagatagatwctcataagctcaaactgtattgtgaatggcacatgcaagggatctaggtttcaggctccttgtgacaatctaatgcctgatgatctgaggttggagcagttttagtccggaaatcattgctcccagcccctgcaccccctggtccgtggtataattgtcttacacaaaacggtctcttgtgtcaaaaaggttggagactactggttttacaaaaaagtaaattagtcaagcatggttgg

SEQ ID NO: 36 - DNA, 725 bp, Homo sapiens
  misc_feature (1)...(725): n = A,T,C or G, or insertion/deletion polymorphism (see Tables 1-2)
catgcttttcgctggttattacatcttgcgtttctctgttgttatgtctgaaaccgtgcctgcagcttctgccagtgctggtstagccgctatggagaaacttccaaccaagaarcgagggaggaagccggctggcttgataagtgcaagtcgcaaagtgcygaacctctctgtgtccaagttgatcaccgrggccntttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaartcagtttctgccaagaccaagaagctggttttatccagggactccaagtcaccaaagactgctaaaaccaataagagagccaagaagycgagagcgacaactcctaaaactgttaggagcgggwgaaaggctaaaggagccaagggtaagcaamagcagaagagcccagtgaaggcaagggcttcgaagtcaaaattgacccaacatcatgaagttaatgttagaaaggccacatctaagaagtaaagagctttccgggaggccaatttggaaagaacccaaaggctcttttaagagccaccca

SEQ ID NO: 37 - DNA, 5011 bp, Homo sapiens
gaagactccagatataggatcactccatgccatcaagaaagttgatgctattgggcccatctcaagctgatcttggcacctctcatgctctgctctcttcaaccagacctctacattccattttggaagaagactaaaaatggtgtttccaatgtggacactgaagagacwaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattrgatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgycagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctrctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacrgaggtgactattccttacctggccacagatgtgacttgtgtggggccaggagcacacaagggccaaagtgtgatctccctggatctgtacacctgtgagttagatctgactaacctrattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaactgcatttctacccttaaaaagtactggtatatacagaaatagggttaaaaaaaactcaagctctctctatatgagaccaaaatgtactagagttagtttagtgaaataaaaaaccagtcagctggccgggcatggtggctcatgcttgtaatcccagcactttgggaggccgaggcaggtggatcacgaggtcaggagtttgagaccagtctggccaacatggtgaaaccccgtctgtactaaaaatacaaaaattagctgggcgtggtggtgggtgcctgtaatcccagctacttgggaggctgaggcaggagaatcgcttgaacccgggaggtggaggtggcagtgagccgagatcacgccactgcaatgcagcccgggcaacagagctagactgtctcaaaagaacaaaaaaaaaaaaacacaaaaaaactcagtcagcttcttaaccaattgcttccgtgtcatccagggccccattctgtgcagattgagtgtgggcaccacacaggtggttgctgcttcagtgcttcctgctctttttscttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagc

SEQ ID NO: 38 - DNA, 2184 bp, Homo sapiens
aatgagagcaacctagcaggtttcatccttttagggttttctgattatsctcagttacagaaggttctatttgtgctcatattgattctgtatttactaactattttggggaataccaccatcattctggtttctcgtctggaacccaagcttcatatgccgatgtatttcttcctttctcatctctccttcctgtaccgctgcttcaccagcagtgttattccccagctcctggtaaacctgtgggaacccatgaaaactatcgcctatggtggctgtttggttcacctttacaactcccatgccctgggatccactgagtgcgtcctcccggctstgatgtcctgtgaccgctatgtggctgtctgccgtcctctccattacactgtcttaatgcatatccatctctgcatggccttggcatctrtggcatggctcagtggaatagccaccaccctggtacagtccaccctcacccygcagctgcccttctgtgggcatcgccaagtggatcatttcatctgcgaggtccctgtgctcatcaagctggcttgtgtgggcaccacgtttamcgaggctgagctttttgtggctagtatccttttccttatagtgcctgtctcattcatcctggtctcctctggctacattgcccacgcagtgttgaggattaagtcagctaccrggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggagccaggatgctctcaatctcctgacctcatgatccacccactttggcctccaagagtggacatggatgaagctggaaaccatcattctcagcaaactatcacaaggtcagaaaaccaaacaccgcatgttctcactcataagtgggaattgaacaatgagaacacatggacacagagaagggaacatcacacacaggggcctgttgtgggatgggggactgggggagggatagcgttaggagaaatacctaatgtaaatgacgagttgataggtgcagcaaaccaacatggcacatctcrtgtrttctgttattctaaatttaattgttttggatgtacccattccattcctgccttaggtgcggatccccctggagggatgggattgggcaatgagagttccctaatggatttcatccttctaggcttctcagaccacyctcgtctggaggctgttctctttgtatttgtccttttcttctacctcctgacccttgtgggaaacttcaccataatcatcatctcatatctggatccccctcttcataccccartgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccackgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttrtttgcraagtwccagctcttctcaagttggcttgtgtggacaccactgtcaatgaattggtgctttttgttgttagtgttctgtttgttgtcattccaccagcactcatctccatctcctatggcttcataactcaagctgtgctgaggatcawatcagtagaggcaaggcayaaagccttcagcacctgctcctcccaccttacagtggtgattatattctatggcaccataatctacrtgtacctgcaacctagtgacagctatgcccaggaccaagggaagtttatctccctcttctacaccatggtgacccccactttaaatcctatcrtctatactttaaggaacaaggatatgaaagaggmtctgaggaaacttctctcgggaaaattgtga

SEQ ID NO: 39 - DNA, 1987 bp, Homo sapiens
  misc_feature (1)...(1987): n = A,T,C or G, or insertion/deletion polymorphism (see Tables 1-2)
atctggcccctgcaggcgtggggttccacgtgggaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcarcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcraaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagstcatacagaggagaaaccctgtgaccataataactgtgggaaaatacttaacaccagcccagatggtcatccatatgagaaaatccacactgcagagaaacaatacgaangtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccytatgagtgtgaggagtgtggtatgagcttcagtcagcgctcaaacctgcacatccaccagcgagtacacacaggagagaggccctacaagtgwggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacwtgttctacccagcattttaacggcaagaactttatatttattctcaagcagggcatgtttccctttgttcacattctctgakaaattgaaactctggtttctcttcaaa

SEQ ID NO: 40 - DNA, 2389 bp, Homo sapiens
  misc_feature (1)...(2389): n = A,T,C or G, or insertion/deletion polymorphism (see Tables 1-2)
ctagtcccgattatggttattacagtttgatgaaatgtggctgagatcattggcactgtggagattaagaaatgtgaggtcagagtgttgggtaarttgttcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcarcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcraaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagstcatacagaggagaaaccctgtgaccataataactgtgggaaaatacttaacaccagcccagatggtcatccatatgagaaaatccacactgcagagaaacaatacgaangtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccytatgagtgtgaggagtgtggtatgagcttcagtcagcgctcaaacctgcacatccaccagcgagtacacacaggagagaggccctacaagtgwggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacwtgttctacccagcattttaacggcaagaactttatatttattctcaagcagggcatgtttccctttgttcacattctctgakaaattgaaactctggtttctcttcaaa

SEQ ID NO: 41 - DNA, 2386 bp, Homo sapiens
  misc_feature (1)...(2386): n = A,T,C or G, or insertion/deletion polymorphism (see Tables 1-2)
ctagtcccgattatggttattacagtttgatgaaatgtggctgagatcattggcactgtggagattaagaaatgtgaggtcagagtgttgggtaaattgtrcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcarcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcraaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagstcatacagaggagaaaccctgtgaccataataactgtgggaaaatacttaacaccagcccagatggtcatccatatgagaaaatccacactgcagagaaacaatacgaangtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgasaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccytatgagtgtgaggagtgtggtatgagcttcagtcagcgctcaaacctgcacatccaccagcgagatcacacaggagagaggccctacaagtgwggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacakccaccagcgggttcacaagaaagatcctcgctaactgacattagcccattcaggtcttcacagcgctcatactgtaaaaactgttaaatatttagtatcactcttactttatattcctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacwtgttctacccagcatttaacggcaagaactttatatttattctcaagcagggcatgtttccctttgttcacattctctgagaaattgaaactctggtttctcttc

SEQ ID NO: 42 - DNA, 1132 bp, Homo sapiens
  misc_feature (1)...(1132): n = A,T,C or G, or insertion/deletion polymorphism (see Tables 1-2)
agctgaagccatggcctcaaagcctgagaagartgtggcatcgtctgtctttatcacccttgcacccctgtgccacgatttagctgtggttgaggaagggggcaggcggtttgtgaggcctgatgtggcctcccctgggaggctcctgcccccatgaaggcacccggagctggcttarcgggaaagcccagcccctgggcaccccctggcagggctgcagccacagtgccagctgcacctctgcagctctccaatggaggatgctcaccccctcctcctgtcctggatggtgaggacgracttcctgacctggacctcgtcccaccccctccactgccccctccggtgctcctgtcttctgaagaagaggctcctgctccaatgggggcctcactcattgcagacttagagcggttgcacctgccctcgcccccaccccgaccacaggccccagtggagggaccttcagtccagcctgggcccagtcccctcgggcctggggaggaagagcttccgccttccccagcagagwctgtrgagagagagtcgtccacagacatctgtgccttctgccacaaaaccgtgtcccccgcaagagctgyctgtggaggccytaaagaggcagtaccatgcccagtgcttcacgtggcacacctgccaccgccagctagctgggcagagcttctaccaggatgggcgacccctctgcaaaccctyctaccagyacacactggagaagtgcggcaagtgtggccaggtggtccgggagcacatcatcagggccctgggccaggccttccacccctcctgcttcatgtgtgtgacctgtgcccggtgcatccaggatgagagctctgccctgggcagccaaancgagatgtactgcctagacgaatyctacaagaaatttgctyscgtatgcagcatctgtgagaatcccattattcctcgggatgggaaagatgccttcaaaatcaagtgcatgggaagaaacttccatgtaaattgctacaggtgtgaggactgcaggatcctcctgtctgtggagcccaggaaccaaggctgctaccccctggacaaccatctcttctgcaagcagtgccacgtgaagcagagtgctgctgggtgctgc

SEQ ID NO: 43 - DNA, 936 bp, Homo sapiens
atgaataactcacagatatctactgtgacgcagtttgtgktgttggggtttcctggtccctggaaaattcagatcatctttttctcaatgattttgttggtctacatcttcactctgactgggaatatggccatcatctgtgcagtgaggtgggaccatcgactccatacccctatgtacgtgctcctagccaacttctccttcctagagatctggtatgtgacctgcacagtccccaacatgctggtaaattttttctccaaaactaagaccatatcattctctggatgtttcactcagttccacttcttcttttccctgggcacaactgaatgcttcttcctctgtgtcatggcttatgatcggtacctggccatctgccacccactgcactatccctccattatgactggccagctctgtggcatcttggtgtctctttgttggctcattggtttccttggacattcaatttccattttcttcatttttcaactacctttctgtkgtcccaacatcattgatcattttctgtgtgatgtagacccactgatggcattgtcctctgcccctactcacatcatagggcatgtgttccattctgtgagctctcttttcatcaacctcaccatggtgtacatccttgggtcctataccttggtgctcagaactgtgcttyaggttccttcttcagctggatggcaaaaggccatctctacctgtgggtcacacttggtkgttgtgtctctgttctatggagccataatgctgatgtatgtgagtcccacacctggcaactcagttgctatgcataagctcatcacactgatatattctgtggtaacacctgtcttaaaccccctcatctacagcctacgcaacaaggacrtgaaatatgccctccatcatgtcttctgtggaatgagaattatccag

SEQ ID NO: 44 - DNA, 1372 bp, Homo sapiens
  misc_feature (1)...(1372): n = A,T,C or G, or insertion/deletion polymorphism (see Tables 1-2)
cacactgggcctccactttgccctctttccttctcttctcctcacagcagtgcctggtcaaacccagcaacccttggccagaacttactcacccatcccactgacaccatgaagcctgtgctgcctctccagttcctggtggtgttctgcctagcactgcagctggtgcctgggagtcccaagcagcgtgttctgaagtatatcttggaacctccaccctgcatatcagcacctgaaaactgtactcacctgtgtacaatgcaggaagattgcgagaaaggatttcagtgctgttcctccttctgtgggatagtctgttcatcagaaacatttcaaaagcgcaacasaatcaaacacaagggctcagaagtcatcatgcctgccaactgaggcatatttcctagatcattttgcctctacgatgttttttcttggtccacctttaggaaggtattgagaagcaagaaactggaggcccaatatctaacctgcaaatcgtttttgagtttggcaataaaggctaatctaccataaaactcttgaagcttaagctttaggtcaacacttgcaagagccccttccaaagctcagcacagtttcctcctgggatgaggagaggaatcagaaaccccactttggcatagagacaagcagcactgttccagtccagggatgctgtgtgtgccctggtggtggtcttaaggacctaccacatcaacatctggacaaccctcactgattacctgcccttggttgcactcatcaggctaantgatcccatatttaacctcaaggagaaatatcaaccagacactgcatggcaacctccttggggccagccttcaaggcttcatggccatatcatgaacccaggacaggcacagtgggggtggtgaggacctgatagagttggatcagtgactaagaggctgcaataaggtgccatgaaatcaaaatcaaagggctagaactctccaaggtcttgcccccggcatgtagcaccacctgagccagaaactgcagaggacatgacagtgtggcattactgataagttatggaaatggaaataatctttcctaaactaccaataataactttaaatttttgatcaaccatgctagagcaaagattgaattatccttctgttctctctacagaaatgatataaaaactatagtcataagaagagacaatcaaaaataatcagccataaaatattaaaaaggtattataaaggtatttaaaataataataataaagtgttattttcctgggattcatgatatttgatatattcgtaagcttttgttaagtttgtaatttgttgcaatttctttttcatttcaaataaatattcacttacgtgtctaa

SEQ ID NO: 45 - DNA, 1307 bp, Homo sapiens
  misc_feature (1)...(1307): n = A,T,C or G, or insertion/deletion polymorphism (see Tables 1-2)
cacactgggcctccactttgccctctttccttctcttctcctcacagcagtgcctggtcaaacccagcaacccttggccagaacttactcacccatcccactgacaccatgaagcctgtgctgcctctccagttcctggtggtgttctgcctagcactgcagctggtgcctgggagtcccaagcagcgtgttctgaagtatatcttggaacctccaccctgcatatcagcacctgaaaactgtactcacctgtgtacaatgcaggaagattgcgagaaaggatttcagtgctgttcctccttctgtgggatagtctgttcatcagaaacatttcaaaagcgcaacasgcctctacgatgttttttcttggtccacctttaggaaggtattgagaagcaagaaactggaggcccaatatctaacctgcaaatcgtttttgagtttggcaataaaggctaatctaccataaaactcttgaagcttaagctttaggtcaacacttgcaagagccccttccaaagctcagcacagtttcctcctgggatgaggagaggaatcagaaaccccactttggcatagagacaagcagcactgttccagtccagggatgctgtgtgtgccctggtggtggtcttaaggacctaccacatcaacatctggacaaccctcactgattacctgcccttggttgcactcatcaggctaantgatcccatatttaacctcaaggagaaatatcaaccagacactgcatggcaacctccttggggccagccttcaaggcttcatggccatatcatgaacccaggacaggcacagtgggggtggtgaggacctgatagagttggatcagtgactaagaggctgcaataaggtgccatgaaatcaaaatcaaagggctagaactctccaaggtcttgcccccggcatgtagcaccacctgagccagaaactgcagaggacatgacagtgtggcattactgataagttatggaaatggaaataatctttcctaaactaccaataataactttaaatttttgatcaaccatgctagagcaaagattgaattatccttctgttctctctacagaaatgatataaaaactatagtcataagaagagacaatcaaaaataatcagccataaaatattaaaaaggtattataaaggtatttaaaataataataataaagtgttattttcctgggattcatgatatttgatatattcgtaagcttttgttaagtttgtaatttgttgcaatttctttttcatttcaaataaatattcacttacgtgtctaa

SEQ ID NO: 46 - DNA, 3309 bp, Homo sapiens
  misc_feature (1)...(3309): n = A,T,C or G, or insertion/deletion polymorphism (see Tables 1-2)
acttgtagaagagaaactactttctgaagaaacagagtgtctgctacgagctcaattttcagattttaagtgggagttatataattggagagaaacagatgagtactccgcagaaatgaaacaatttgcatgtacrctctacttgtgcagtagcaaagtctatgattatgtaagaaagattcttaagctgcctcattcttccatcctcagaacgagcggccagtgaggcaggaggaaaaccaggagattgtgatggcctggaagccaagtgtagaaagtatttcaaggagggagtagtccactatgtcaaatgctgctgggagatcaggtggttatccaaatgccaacccagtccaggtttcaacagcaacattttttcttttcttcaacgaagagtagagaatggagatcagctctatcaatactgttcattgttaataaaaagtatncctctcaagcaacagcttcagtgggatcctagcagtcacagtttkcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctraagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaaractggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattnatctttttgtagatgtgaataagcatctctttgatggagaagtgtgtgccatcaatcactttrtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaaygatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttacgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagaggyacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagatta

SEQ ID NO: 47 - DNA, 3194 bp, Homo sapiens
  misc_feature (1)...(3194): n = A,T,C or G, or insertion/deletion polymorphism (see Tables 1-2)
acttgtagaagagaaactactttctgaagaaacagagtgtctgctacgagctcaattttcagattttaagtgggagttatataattggagagaaacagatgagtactccgcagaaatgaaacaatttgcatgtacrctctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatncctctcaagcaacagcttcagtgggatcctagcagtcacagtttkcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctraagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaaractggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattnatctttttgtagatgtgaataagcatctctttgatggagaagtgtgtgccatcaatcactttrtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaaygatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttacgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagaggyacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagatta

SEQ ID NO: 48 - DNA, 1905 bp, Homo sapiens
gtactcctcacaccacttaacagccacttgtttcatcccacctgggcattaggttgacttcraagatgcctcagttactgcaaaacattaatgggatcatcgaggccttcaggcgctatgcaaggacggagggcaactgcacagygctcacccgaggggagctgaaaagactcttggagcaagagtttgccgatgtgattgtgaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctgggcgaaggacagagaagtggcactgaagtgggaagggcggggaaagggcagcattatgaggggagcagccacagacagagccagcagggttccagagggcagaacaggcctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtsagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacasggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacaggrccargatgcagcccagtcagaagagaagcgargcatcacagctagagagctgtattcctacttgagaagcaccaagccatgacttccccractccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactggc

SEQ ID NO: 49 - DNA, 4333 bp, Homo sapiens
tgaggggagtcgagactcccgcgccccaccacccccggcggagctgctgctgagccactcaatctgagccctggctactaataaaatttgagagggaagatctgatctcctagaattagagttggtayagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcamtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattsaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcrcttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgayctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaa

SEQ ID NO: 50 - DNA, 4522 bp, Homo sapiens
gctccgcagcgcggcgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcamtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattsaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcrcttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgayctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaa

SEQ ID NO: 51 - DNA, 4344 bp, Homo sapiens
gttccattgacactggttgctacagaattaactttactcggagatccgaggagccatcggcagttcccaggagtaagaacctgagagcgtgtgagaatttgagagggaagatctgatctcctagaattagagttggtayagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcamtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattsaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcrcttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgayctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaa

SEQ ID NO: 52 - DNA, 4828 bp, Homo sapiens
gctccgcagcgcggcgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcgatttgagagggaagatctgatctcctagaattagagttggtayagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcamtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattsaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcrcttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgayctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaa

SEQ ID NO: 53 - DNA, 6179 bp, Homo sapiens
ccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatttcactcttgtcgcccaagctggagtgcaatggcatgatctcggctcactgcaacctccgcctcctgggttcaatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaarggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgyctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcagrctatacgggyagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaratagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcat

SEQ ID NO: 54 - DNA, 6104 bp, Homo sapiens
ccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaarggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgyctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcagrctatacgggyagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaratagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcat

SEQ ID NO: 55 - DNA, 6036 bp, Homo sapiens
ccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaarggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgyctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcagrctatacgggyagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaratagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaa

SEQ ID NO: 56 - DNA, 3504 bp, Homo sapiens
atgtcgaagacgctgaagaagaagaggcactggctcagcaaggtgcaggagtgcgccgtgtcctgggccgggcccccgggagacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcagaaaacggagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaarggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcgttgatggaattcctgttaaagggaaatcacacaaacaagtcttggacctcatgacaactgctgctccaaatggccatgtgttactaactgtcagacggaagatcttctatggagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggccagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctat

SEQ ID NO: 57 - DNA, 3234 bp, Homo sapiens
acacacacacacacacacacacacacacacacacacacacacctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactcttycaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtrtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttytctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 58 - DNA, 3446 bp, Homo sapiens
acacacacacacacacacacacacacacacacacacacacacctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactcttycaagatgagataaactggcgcctcaaggagggactggtggaaggcgaggattatgtgctgctcccagcagctgcttggcattacctggtcagctggtatggtctagagcatggccagccacccattgaacgcaaggtataatggatggggagggtgcatggcggggagtgcgtagtaagaaagccttgtaggcccagcatgggtacagatccatgtatgctgggtaggtacacatatgtctgctctcttccccctcctagctcatcatacaggtatctttgtctgctgtgtgtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtrtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttytctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccc

SEQ ID NO: 59 - DNA, 3192 bp, Homo sapiens
ctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactcttycaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtrtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttytctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 60 - DNA, 3290 bp, Homo sapiens
atggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactcttycaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtrtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttytctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 61 - DNA, 3293 bp, Homo sapiens
cgagttggaagaggtgagtcctgtctcaaaatggaggtaaaaccgccgcctggttgcccccagcccgactccggcagtcgccgtcgccactggggggaggagggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatgcgtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtsgtggaggtggatctggcaattgtatgggtcrcagaggaaactttggaggtggtggaggtaattttggccgtgatggaaactttggtggaagaggaggctatggtggtggaggtggtggcagcagaggtagttatggaggaggtgatgtggatataatggattaggaggtgatggtggcaactatggcagtggtcctggttatagtagtagaggcgggtatggtggtggtggaccaggatatggaaaccaaggtggtggatatggtggcggtgttggaggatatgatggttacaatgaaggaggaaattttgrcggtrgtaactatggtggtggtgggaactataatgattttggaaattacagtggacaacagcaatcaaattmtggacacatgaaagggggcagttttggtggaagaagctcgggcagtccctatggtggtggttatggatctggtggtggaagtggtggatatggtagcagaaggttctaaaaacagcaggaaagggctacagttcttagcaggagagagagtgaggagttgtcaggaaagctacaggttactttgagacagtcgtcccaagtgcattagaggaactgtaaaaatctgtcacakaaggaacgatgatccataatcagaaaagttactgcagcttaaacaggaaacccttcttgttcaggactgtcatagccacagtttgcaggaagtgcagctatcgattaatgcaatgtagcgtcaattagatgtacattcctcaggtcttttatctgttgtagctttgtcttattctttttcttttcattacatcaggtatattgccctgtaaattgtggtagtggtaccaggaataaaaaattaaggaatttttaacttttcaatatctgtgtagttcagtttttctacattttagtacagaaactttaacaaaatgcagttttgaaggtgtttccttgtgagttaacaagtaaagaagatcaattgttaattactattttgtataaattttgctaaagttaactgtaaagaaacacctgctgacttgcagtttaaggggaatctattctccccatttccaaaccatgatatgaatggacgccgacatgtggagagaacagataatttgtgtgtttgcaatgtgtgttttaggtaaataggattgggtatttaaattagcatttgtgaatttaatagcattaagattaccttcaaataaaaaagtctcaaaatttctttttggtttttgtgcactttcttttaaaatgtaatcacatgattttagtgtgttagacttgctgagtcctagctgtgtttagaacatctccattctacatttaccttggtcaaatttgaactgctgccataggttttgggtgtaaagaatgtttactgccctccatttaaattctgaaaaggtatagtggatgttttccctctcctacattagaaaccattcttaaaaacttttcaaaatatagaaccattaagcctgctatatctgagcaaattagtgggtaccttttttccttttttaaagcacaagaggcccataaatcttgagttatttgcattagtttacattttttgatacaacttttcagaccaagagaataaaaatcatgcgttattaaacccctagctggctggcatgctttcctgtttgtactgtatacattttgctggatgaaaccaaggatagtttaggtataattgtccaaaataacctaactgcagcagaaatgtaggacagttgcttagtacaggcttctcacttcctacagacctgaattcaaatttggatagtctgagttattaaattcccaaagacaaagaacacactcttatttcttgtgtatatttcaacataaatcatgttgttaccaatttgttgggaaggccctggttgagaagagttttagataataaggctgtatatatatagatatatatagatatataccaatgtctatatatagagatattttatatatatatatacaggtatatatatgtgtgtgtatatatataggtatatacatatatacatatatatatatatatatatggatatatacccatgtctactgttttgcttcagctagtgcttacaatttcattcaagtcctgagtatgtgtcctgctgttactccttctttggtagttgaacgttgaattcaagtctttccttctgttttaagaagtactaagcaaacaagcaataaaaaggggaatggcgcatgctagtgtttgaatatgctctcttgttgctctaattctgtgcctccgtgcattaatatttggatgcatgcaatgccagcatggaaattggccttcacacttactgcagttttccagaaacactcacaagccaataaatgtaacagacattccatttttaatgggcatatatgtgaaaagcagtgtagaaaataggctaatattagaaaatggttaagtccttaataacttcaagtgtggttatataatggacactgtcaatgttcataacttaaacctgggtacctggtcaaaataatgcttgggaaacattaaaattgagctaaattgtctcaagttcttttattcatataaataaagtttaaatgaatgggggagatt

SEQ ID NO: 62 - DNA, 3043 bp, Homo sapiens
cgagttggaagaggtgagtcctgtctcaaaatggaggtaaaaccgccgcctggttgcccccagcccgactccggcagtcgccgtcgccgctggggggaggrgggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatcggtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtsgtggaggtggatctggcaattgtatgggtcrcagaggaaactttggaggtggtggaggtaattttggccgtgatggaaactttggtggaagaggaggctatggtggtggaggtggtggcagcagaggtagttatggaggaggtgatgtggatataatggattaggaggtgatggtggcaactatggcagtggtcctggttatagtagtagaggcgggtatggtggtggtggaccaggatatggaaaccaaggtggtggatatggtggcggtgttggaggatatgatggttacaatgaaggaggaaattttgrcggtrgtaactatggtggtggtgggaactataatgattttggaaattacagtggacaacagcaatcaaattmtggacacatgaaagggggcagttttggtggaagaagctcgggcagtccctatggtggtggttatggatctggtggtggaagtggtggatatggtagcagaaggttctaaaaacagcaggaaaagggctacagttcttagcaggagagagagtgaggagttgtcaggaaagctgcaggttactttgagacagtcgtcccaagtgcattagaggaactgtaaaaatctgtcacakaaggaacgatgatccataatcagaaaagttactgcagcttaaacaggaaacccttcttgttcaggactgtcatagccacagtttgcaaaaagtgcagctattgattaatgcaatgtagtgtcaattagatgtacattcctgaggttcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaaccttttttccttttttaaagcacaagaggcccataaatcttgagttatttgcattagtttacattttttgatacaacttttcagaccaagagaataaaaatcatgcgttattaaacccctagctggctggcatgctttcctgtttgtactgtatacattttgctggatgaaaccaagatagtttaggtataattgtccaaaataacctaactgcagcagaaatgtaggacagttgcttagtacaggcttctcacttcctacagacctgaattcaaatttggatagtctgagttattaaattcccaaagacaaagaacacactcttatttcttgtgtatatttcaacataaatcatgttgttaccaatttgttgggaaggccctggttgagaagagttttagataataaggctgtatatatatagatatatatagatatataccaatgtctatatatagagatattttatatatatatatacaggtatatatatgtgtgtgtatatatatatatgtatatacatatatacatatatatatatatatggatatatacatatatatatatatatggatatatacccatgtctactgttttgcttcagctagtgcttacaatttcattcaagtcctgagtatgtgtcctgctgttactccttctttggtagttgaaagttgaattcaagtctttccttctgttttaagaagtactaagcaaacaagcaataaaaaggggaatggcgcatgctagtgtttgaatatgctctcttgttgctctaattctgtgcctccgtgcattaatatttggatgcatgcaatgccacatggaaattggcctcatggc

SEQ ID NO: 63 - DNA, 990 bp, Homo sapiens
tcaccatagaggttcctgaggtcacagtgttttccaagtytccygtgacactgggtcagcccaacaycctcatytgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgmtgatgagatttatgactgcaaggtggagcactggggcctggayragcctcttctgaaacactgggagcctgagattccarcacctatgtcagagctcacagagactktggtctgygccctgggrttgtctgtgggcctcrtgggcattgtggtgggsacygtcttsatcatccraggcctgcgttcagttggtgcttccagacaccaagggcccttgtgaatcccatcctgaaaargaaggtgttacctactaagagatgcctggggtaagccgcccagctacctaattcctcagtaacmtcgatctawaatctccatggaagcaayaaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaaaatatcaaaagtaaaaatttattctca

SEQ ID NO: 64 - DNA, 455 bp, Homo sapiens
atcagctgaccacgttgcctcttgtggtgtaaacttgtaccagtyttacggtccctctggccagtacacccatgaatttgatggagaygagsagttctacgtggacctggrgaggaaggagactgyctggyggtggcctgagttcagcaaatttrgaggttttgacccgcagkktgcactgasaaacatsgctgtgrcaaaacacaacttgaacatcatgattaaacgctmcaactctacygctgctaccaatgaggttcctgaggtcacagtgttttccaagtctcccgtgacrctgggtcagcccaacaycctcatytgtcttgtggacaacatctttcctcctgtggtcaacatcacatggctgagcaatgggcastcagtcacagaaggtgtttctgagaccagcttcctctccaagagtgatcattccttcttcaagatcagttacctca

SEQ ID NO: 65 - DNA, 475 bp, Homo sapiens
catcagctgaccacgttgcctcttgtggtgtaaacttgtaccagtyttacggtccctctggccagtacacccatgaatttgatggagaygagsagttctacgtggacctggrgaggaaggagactgyctggyggtggcctgagttcagcaaatttrgaggttttgacccgcagkktgcactgasaaacatsgctgtgrcaaaacacaacttgaacatcatgattaaacgctmcaactctacygctgctaccaatgtgctgtttcctcaccacagaggttcctgaggtcacagtgttttccaagtctcccgtgacrctgggtcagcccaacaycctcatytgtcttgtggacaacatctttcctcctgtggtcaacatcacatggctgagcaatgggcastcagtcacagaaggtgtttctgagaccagcttcctctccaagagtgatcattccttcttcaagatcagttacctca

SEQ ID NO: 66 - DNA, 2051 bp, Homo sapiens
cacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttyatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccarcattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggartttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccrggcacggtggctcatgcctataatcccagcactttgggaggccaaggtgggtggatcacctgaggtcaggrgttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtwacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactrataaataaartacttactgaatttccaccattcaaattcat

SEQ ID NO: 67 - DNA, 1497 bp, Homo sapiens
cacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttyatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccarcattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggarccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtwacttgggtaccgggggaactttaaaatttcatctcaaaaataattttta

SEQ ID NO: 68 - DNA, 3674 bp, Homo sapiens
tgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacaggggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacargctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcamcatgctgtcccagggcgtgtccatgctctattccttcttcatgccakctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 69 - DNA, 3561 bp, Homo sapiens
ctcttccgttgccccgtggcttcagctcatctttggcaggaaggcgaggcttccgcccggcacagggggtgagctggagcaccgtgcccccaagcctctggacagcatttggaggaggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcaggatctggcacccataaacgccttcattgggggcctggctgcccagraagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaycctagatggcgtggccaatgccctggacaacgtggatgcrcgtgagsttggaggcgggtgaggtggtcacgggcaaagttgtgtgtgtttcggtgtgtatataccaagaggggtgtccgtctttctgtcctctcctgatgtttctttcctagctctcgctttgtgctccccacaggcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgcggtggcttacgcctgtaatcccagcactttgggaggccgaggcacgtggttcacctgaagtcaggagtttgagaccagcctggccaacatgatgaaaccctgtctctactaaa

SEQ ID NO: 70 - DNA, 3951 bp, Homo sapiens
gttgctggttgttagtctaccaaccactcaacttcatgcataacttataatcaggaagcatggccttaacggtttttcttcgcttccttgacagcctggctgcaacaattcattcattagtcgcattccatgaggcgtggcctctgttttacctgttttcgttgttactgccacaatgtccaccaggtggtgctgttccacttctaaccgaatgaatcgcaaccgagtagggaactttatgcatgattcataagtaggcgcggcccgcttgcatccgggtttctgggggtggggcccaaggttttgttccggccccaggctcagcgtccgccatcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctggrtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccmcgaccacagcagccgtggttggccttgtgtgtctggagctgtacaakgttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 71 - DNA, 3541 bp, Homo sapiens
ctcttccgttgccccgtggcttcagctcatctttggcaggaaggcgaggcttccgcccggcacagggggtgagctggagcaccgtgcccccaagcctctggacagcatttggaggaggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccagraagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgmgcgctggtgcttgagctgtgctgtaacgacgagagcggcgaggatgkcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 72 - DNA, 2627 bp, Homo sapiens
  misc_feature (1)...(2627): n = A,T,C or G, or insertion/deletion polymorphism (see Tables 1-2)
ggtccagcctgtctccgcgtggtgcgagcgctgcaccagcccctggctggtggttactgtccgaacggcgtggtgtggtcgctgactctctgggcgtgcagctccgcagccctgccggctcggttcgattgacttacgcaggattctcagcccttgcctgggagaacagttcaggagacagatggccccaagagcccagatccagggaccgctgacatttggggatgtggctgtggcytttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgyagcatrtgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccngaaaccctacaaatgtaatgactgtgggaargccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagcagttatctctctctttctctcttttttttttttttttaaaagaaactagctcttactctgtcacccaggctggagtgccatgtgatcatagctcactgtagttttgaacttgggcttgaacaaccttcccacttcagtctctggagtagctggggctacaggcacgtaccaccacactcagctaacagyagttatctttgatgaggatgtagtataggttgagcatccataactggaaaatctgaaatctgaagtgctccaaaatccaaaatttgtctgagcaccaacaggtacaaaattctacaccagaccttatgtgatgggttgcagttaaaatgcacccccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccarctactcgggaggctgaggcaggagaatggcgtgaacctgggaagcggagcttgcagtgagccgagattgcacc

SEQ ID NO: 73 - DNA, 2644 bp, Homo sapiens
  misc_feature (1)...(2644): n = A,T,C or G, or insertion/deletion polymorphism (see Tables 1-2)
ggtccagcctgtctccgcgtggtgcgagcgctgcaccagcccctggctggtggttactgtccgaacggcgtggtgtggtcgctgactctctgggcgtgcagctccgcagccctgccggctcggttcggttcgtgagcggccgggattgacttacgcaggattctcagcccttgcctgggagaacagttcaggagacagatggccccaagagcccagatccagggaccgctgacatttggggatgtggctgtggcytttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgyagcatrtgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccngaaaccctacaaatgtaatgactgtgggaargccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtagttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaaatatacccatgataatatacccaatatacccttgttaaagaagcaagtttcaggaaatctatattatatgcattcaaaaagacctggacaaataaagaccaatcttaacagcagttatctctctctttctctcttttttttttttttttaaaagaaactagctcttactctgtcacccaggctggagtgccatgtgatcatagctcactgtagttttgaacttgggcttgaacaaccttcccacttcagtctctggagtagctggggctacaggcacgtaccaccacactcagctaacagyagttatctttgatgaggatgtagtataggttgagcatccataactggaaaatctgaaatctgaagtgctccaaaatccaaaatttgtctgagcaccaacaggtacaaaattctacaccagaccttatgtgatgggttgcagttaaaatgcacccccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccarctactcgggaggctgaggcaggagaatggcgtgaacctgggaagcggagcttgcagtgagccgagattgcacc

SEQ ID NO: 74 - DNA, 2070 bp, Homo sapiens
  misc_feature (1)...(2070): n = A,T,C or G, or insertion/deletion polymorphism (see Tables 1-2)
cctgtctccgcgtggtgcgagcgctgcaccagcccctggctggtggttactgtccgaacggcgtggtgtggtcgctgactctctgggcgtgcagctccgcagccctgccggctcggttcggttcgtgagcggccgggattgacttacgcaggattctcagcccttgcctgggagaacagttcaggagacagatggcccccaagagcccagatccagggaccgctgacatttggggatgtggctgtggcytttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacaaagatgtcagccctaaagcaaagcacttctgyagcatrcgttctgggagagcgaacgaaaagtgtcatgatggaaaaaggcctggactgggagggcagaagctccacagagaagaactataagtgcaaggaatgtgggaaagtcttcaaatacaattcgtcctttattagccaccagagaaatcacaccagtgagaaaccacataaatgtaaagaatgtgggatcgcctttatgaacagttcatcccttttaaatcaccataaggttcatgcaggcaaacagccttatagatgtattgaatgtgggaagttcctgaagaagcactcaacgtttatcaaccatcagagaattcattctagggagaaaccccacaaatgcattgaatgtggaaaaactttcagaaagaactcaatccttttaagtcatcagagaattcatactggccngaaaccctacaaatgtaatgactgtgggaargccttcgctcagaatgcagctcttactcgtcatgaaagaatacatagtggagagaagccttttaaatgtaacaagtgtgggagagctttcagggataattcaactgtgttggaacatcagaaaatccatactggtgagaagccatatcagtgtaatgaatgtggaaaagcctttaggaagagctcaactcttattagtcaccaaagaatgcatactggggagaaaccctatcactgcagtaaatgtggaaaatctttcaggtatagctcatcctttgctggtcatcagaaaactcacagtggaaataaaccgtatcagtgtcgtgactgtgggaaggcctttacaaagagctcaacccttactggacatcagagaattcatactggagaaaaaccctatcactgtaagaaatgtgggaaagcctttcggcacagctcaggccttgttgaacatcagagactccatactggggaaaaaccttataaatgtaatgaatgtgggaaagcttttccccgaagttcagcccttaagcaacataagaaaattcataataaagaaagagccatgaaatgtagttagtgtggcaaattgtgcagagtagtttattccttctgaccatcatagaggagacattaaataaattatgcatttaacagaaatactctgtacttctgagagaacacatcacttgtgaggatattcattgtgaggttctactagtgaaatatttgaagaaactaaatgtatgtcagtatggaagtacttatagcatactgtgtgctaattgaaaagaatgaggtggagctgtaaatactgtacaaagccaggcatggtggcatatgcctgtagtcccagttacttgggaggctgagacaggattgcttaagcccaggagtttgagtctgtaatgcactatgattgtgcatgtgaatagccactgcactccagcctgggcaacatagcaagactccatctctaagtaaaaaaatacaacagtagaagtatacccatgataatatacccaatatacccttgttaaagaagcaagtttcaggaaatctatattatatgcattcaaaaagacctggacaaataaagaccaatcttaacagcaaaaaaaaaaaaaaaaaa

SEQ ID NO: 75 - DNA, 1963 bp, Homo sapiens
  misc_feature (1)...(1963): n = A,T,C or G, or insertion/deletion polymorphism (see Tables 1-2)
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccntctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcaca

SEQ ID NO: 76 - DNA, 3387 bp, Homo sapiens
  misc_feature (1)...(3387): n = A,T,C or G, or insertion/deletion polymorphism (see Tables 1-2)
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctrgccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcactggaggcctgtggcctcgtggagaccatccatatcagtgctgctggcttccccatccgggtctctcacmgaaactttgtagaacgatacaagttactaagaaggcttcatcctygcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactrtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagyggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcntctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgmccaagtttaactccatatgaagtgtaagcttgatatcgtttatgatgtctatcaactgtaccaaaagtaaaacatttaaaaac

SEQ ID NO: 77 - DNA, 3417 bp, Homo sapiens
  misc_feature (1)...(3417): n = A,T,C or G, or insertion/deletion polymorphism (see Tables 1-2)
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcaggtttgtgccaaatggggccacagccccccagatgcgagacagggatgggtccaattgtgtctggcagagatgggcacttgggccatgattgggagctgcccttctgctgtcgtgattgtactcagcagaacggcccttcccagagtaggcccacgtcaygccctctcctactcccacccatccttttctttcccccaggtcctagctggactgctgcaccttggcaatatccagtttgctgcctccgaggatgaagcccagccctgccagccgatggatgatgccaagtgtgaggactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctrgccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcactggaggcctgtggcctcgtggagaccatccatatcagtgctgctggcttccccatccgggtctctcacmgaaactttgtagaacgatacaagttactaagaaggcttcatcctygcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactrtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagyggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcntctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgmccaagtttaactccatatgaagtgtaagcttgatatcgtttatgatgtctatcaactgtaccaaaagtaaaacatttaaaaac

SEQ ID NO: 78 - DNA, 2066 bp, Homo sapiens
  misc_feature (1)...(2066): n = A,T,C or G, or insertion/deletion polymorphism (see Tables 1-2)
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtgtgagggtcagggtgtaggatggggcaggccctgtcaggaaggtagccagcattgctggggttgggtggaaggctggatggtgaaaattggaatctgatgcccttgcttatgccacccaccatagggcctggccctggatcatttactcctcaccctgtctggtgaggcagacagtatcgtccccatcttaaagatgagaaaatgagtcagaggtttgtaaagtgatttgtcccatacatggcagcatggactggtacatgaaagtgctgggtttgagttctgactgcngtttatggagtcctttgggtgagtcacttcactgatcagaacttaggtttcttctgtccagttgggcaagtcatggtcccgctgtgatgacttcacagtgcctcgtgaagaggactggatggagagtgatttgcctaaagaggatttgcccctcccagactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctrgccaaactgatctatgcgcg

SEQ ID NO: 79 - DNA, 1699 bp, Homo sapiens
  misc_feature (1)...(1699): n = A,T,C or G, or insertion/deletion polymorphism (see Tables 1-2)
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccntctgtgctacctccaaggaatcagtcacctctgttctgctgagtctggagaccaggtggtggggtggacggggcataaggaagagtgatgcatacacagtgctagagtacagaatgcagtaagtgatccatgggggcagagagcaaggtaccgcatgatcagaagagagaactagtgctaccgccttgcttgtctagtacattaaaacttacaagtcatgttcaca

SEQ ID NO: 80 - DNA, 4378 bp, Homo sapiens
  misc_feature (1)...(4378): n = A,T,C or G, or insertion/deletion polymorphism (see Tables 1-2)
cgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacagattggcttaggcccagcctcacaacaccccacctcccagatggattcatctccctgaaatcctcaccttcttgaagttgacactggaccgttcacctgattagcgctcccaaatggatcatcaacccttagtcgtagtgctaacagtgtttatcctctgagtgaatactcagattcgtactttgtgtggtgctgtcaaaccatgacctcattgaccttcacaaccactccttatgaggcagatttaactgtccccattttcaaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtgtgagggtcagggtgtttcttctgtccagttgggcaagtcatggtcccgctgtgatgacttcacagtgcctcgtgaagaggactggatggagagtgatttgcctaaagaggatttgcccctcccagactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctrgccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagcagcattttgtggctcactacctaagggcccagcaggaggaatacgcagttgagggcctggagtggtcattcatcaactaccaggacaaccagccctgtttggatctcattgagggaagccccatcagcatctgctccctcataaatgaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcacmgaaactttgtagaacgatacaagttactaagaaggcttcatcctygcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactrtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagyggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcntctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtacagtagaatcacgttttgattttattaacactgmccaagtttaactccatatgaagtgtaagcttgatatcgtttatgatgtctatcaactgtaccaaaagtaaaacatttaaaaac

SEQ ID NO: 81 - DNA, 3209 bp, Homo sapiens
  misc_feature (1)...(3209): n = A,T,C or G, or insertion/deletion polymorphism (see Tables 1-2)
gttcttcccgccgcctgacctggcccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcartggccacaatccrgggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgytgcctratgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctrgccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctgcagctggaggcctgtggcctcgtggagaccatccatatcagtgctgctggcttccccatccgggtctctcacmgaaactttgtagaacgatacaagttactaagaaggcttcatcctygcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactrtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagyggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcntctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtgatccttggtgcctttgtttccacaaggccttttcctgccccctgccttgccaaagacatttaatcagcacacagctgccagactattcccacagtgctccaaatgcacatgaacaacagtgacggctccagccttcgacccagagccccgtgcccagtgcgtcagtgggcctggggttccaggctacatcaagcactgatggtgtcagggctggtagttaccaaatcagggttaagaaacatcagggccacatttcactaccttcacagatcaaactcagcagcagtcatgactgtctgtcactacactggggatcccaattccacataagcacttttggaagaaaacagccaaagttggcctaaaattggcgctggaatttgggctgggaaaaatcttgtggttatttcctttaaaaaggaacaaaactttagtatttaattagttgatttatttaatgtaatttcaaacaattaaattatgaataatgcaatgtaaaaaaaaaaaaaaaaaa

SEQ ID NO: 82 - DNA, 336 bp, Homo sapiens
atgtrgasgggtagtgabctgcgcccccggccggtgtcactcacaggcctcactctggttgtagtrgccgctcagggtccgcaggttcactcggtaaaactgtgctttggccttggcggtccctgtctcctcttcccaatattccggcccctcckgctccatccacggcgcccgcggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtggaagcctgggagcaaggagggggctga

SEQ ID NO: 83 - DNA, 2997 bp, Homo sapiens
gttctcatgtgttccatttattttgtctctcaaattttaggaatcttctcctttaattaactcatcaacctctcatggcaagaatttgagaaagkaaatttatactmaggttctaattttaatagggaaggaagaagttacagctcagtgcaccatgaagttgagacagagatggagacacctcagccccacctctctgsaacaggaaagatgattggrgagggagcacaggtcagcgtgggaagagggtcatggtggacatsggggtggggtggtctccccacctcctcacattatgcctacaygaacacagacacatgcaggtgcctttgcagaaacaaagtcagggttcttcaagycacaaagggaagggcaggaacaactcttgcctctcagtcccacacaaggcagctgtctcacactttacaagctgtgagagacacatcagagccctgggcactgtcactgcttgcagcctgagtcctcctccacctcacagcagcgaccacagctccagtgatcacagctccaaagagaaccaggccagcaatgatgcccacgatggggatggtgggctgggaagacggctcccatctcagggtgaggggcttgggcaaaccctcatgctgcacatggcaggtgtatctctkctcctgtccagaaggyaccaccacagmcgcccacttctggaaggttccatcccctgcaggcctggtctccacgagctccgtgtcctgggtctggtcctccccatcccgctgccaggtcagtgtgatctccgcagggtagaagctcagggcccagcacctcagrgtggcytcatggtcagagacagcgtggtgagtcatatgcgttttgggggcgtccgtgcgctgcagcgtctccttcccgttctccaggtatctgcggagccactccacgcacgtgccmtccaggtaggctctcaactgctccgccasaygggccgyctcccacttgygctkggtgrtctgagcygccatgtccgccgcggtccaagagcgcaggtcctckttcarggcgatgtaatccttgccgtcgtargcgtmctgcyggtacccgcggaggargcgccmgtccgaccccacgtcgcagccawacatymtctggatgggtgttagaccctggccccgcccccgctgtcagccccgcccaccgagccccgcccccgccccgaccaacccgcggggattttggctgaaaatgaaaccgggtaaaggcgcctgggcctctcccaggtcaagggtctcggggtcccgcggtttcggggaggatctcggacccagagactcgaggcgacccggccctccgtgggggatggggaggggtcgtgacctgcgccccgggccggggtcactcaccgccctcgctctggttgtagtagctgtctcctcttcccaatactcyggcccctcctgctccacccacggcgcccgcggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtggaagcctgggagcaaggagggggctgagacyctcccgaccctcctcccggcaccgcaaccgggttcctgmgcccccgccgggcaggmccctagctactccccacagasgccgtttccctcccgaccccgcactcacctgcccaggtctgggtcaggaccagggcccccgagagcagcagaagcagggttcggggcgccatgacaccatcctcggcgactggggagaatcggagtcccggtgggtgcgtgggaactttagaaccgggaccgcggctacattgattggcttctctaggaacccgacactcaatgggagtgagaactggggcagcctggtgagtatccaggaagaaggacccgacacaggttgggagagggagaagagaaaccctgcggagatggggaatccccagcgctgggcctccccaatccatacaccgcctttggggcctgagatcctgagagccatgcctgaggccctgggacttcgccctgaccccgctacttctgtgccaagcgctctgtctcaacgtttccgagtcttggcccaggagctgtctgagaaaccagggagaaaccctcgaaatgggccccgttcctctctcttcactttgcatcacggaatccccgtcccagaactggactccctgcctcctactccttacctgtccccgtggactcttctagaagaaaaatcacyccagggagcttgttgccagagagtgagcttgccctgggaatggaggtgtagagacagggttttttgttgttrttgtttgtttgttttttaaatctggaaaagttgtgcctgagtgcatgagatagaatagagaccagtttgctttttgtttattaactacagtgggtagcagaatcttggtaactcctaatgatcaggaatctaatyggccaaaaatgtgactttggtcccttgacatataaatgtgtctaaaagcattacaacaggaatcacaaagctcctaagtttcactttcccagacaatgtatctgtgactcccgcttgtagtattttaaatttaccttcattccatagccctgagtttctgtgtgagtccaggacatctcctaatacaaggtagccactgtgttactatatgttgtaaccaggagccagtacrgactttattcayctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaacctg

SEQ ID NO: 84 - DNA, 1567 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcstcctgctactctygggggcyctggccctgacccagacctgggcgggctcycactccatgaggtatttcwhcacmtccrtgtcccggcccggcmgyggrgagccccgcttcatcgcmgtgggctacgtggacgacwcgcagttcgtgcggttygacagcgacgccgcgagccagargatggagccgcgggcaccgtggatagagcaggagrrkcckgagtattgggacsrgcasacasggaawgtsaaggcccaskcacagaytgaccgaghgracctgsggaccctgcgcggctactacaaccagagcgaggmcggttctcacaccatccagakratgtwtggctgcgacgtggggtcggackggcgcytcctccgcgggtaccrgcagkacgcytacgacggcaaggattacatcgccytgaamgaggacctgcgctcttggaccgcggcggacatggcrgctcagaycaccmagcrcaagtgggagrcggcccrtstggcggagcagttgagagcctacctggakggcacgtgcgtggagtggctccgcagatacctggagaacgggaaggagacgctgcagcgcacggacgcccccaaaacgcatatgactcaccacgctgtctctgaccatgargccacyctgaggtgctgggccctgagcttctaccctgcggagatcacactgacctggcagcgggatggggaggaccagacccaggacacggagctcgtggagaccaggcctgcaggggatggaaccttccagaagtgggcgkctgtggtggtrccttctggacaggagmagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgaggtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgrcttgaagaaccctgactttgtttctgcaaaggcaccttccaccatgaccctcttcccacgctgacctgtgctccctcyccaatcatctttcctgttscagag

SEQ ID NO: 85 - DNA, 1826 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcstcctgctactctygggggcyctggccctgacccagacctgggcgggctcycactccatgaggtatttcwhcacmtccrtgtcccggcccggcmgyggrgagccccgcttcatcgcmgtgggctacgtggacgacwcgcagttcgtgcggttygacagcgacgccgcgagccagargatggagccgcgggcaccgtggatagagcaggagrrkcckgagtattgggacsrgcasacasggaawgtsaaggcccaskcacagaytgaccgaghgracctgsggaccctgcgcggctactacaaccagagcgaggmcggttctcacaccatccagakratgtwtggctgcgacgtggggtcggackggcgcytcctccgcgggtaccrgcagkacgcytacgacggcaaggattacatcgccytgaamgaggacctgcgctcttggaccgcggcggacatggcrgctcagaycaccmagcrcaagtgggagrcggcccrtstggcggagcagttgagagcctacctggakggcacgtgcgtggagtggctccgcagatacctggagaacgggaaggagacgctgcagcgcacggacgcccccaaaacgcatatgactcaccacgctgtctctgaccatgargccacyctgaggtgctgggccctgagcttctaccctgcggagatcacactgacctggcagcgggatggggaggaccagacccaggacacggagctcgtggagaccaggcctgcaggggatggaaccttccagaagtgggcgkctgtggtggtrccttctggacaggagmagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgaggtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgrcttgaagaaccctgactttgtttctgcaaaggcacctgcatgtgtctgtgttcrtgtaggcataatgtgaggaggtggggagaccaccccaccccsatgtccaccatgaccctcttcccacgctgacctgtgctccctcyccaatcatctttcctgttscagagaggtggggctgaggtgtctccatctctgtctcaacttcatggtgcactgagctgtaacttcttccttccctattaaaattagaacctkagtataaatttmctttctcaaattcttgccatgagaggttgatgagttaattaaaggagaagattcctaaaatttgagagacaaaataaatggaacacatgagaacctt

SEQ ID NO: 86 - DNA, 1098 bp, Homo sapiens
  misc_feature (1)...(1098): n = A,T,C or G, or insertion/deletion polymorphism (see Tables 1-2)
atggccgtcatggcgccccgaaccctcctcctgctactctcgggggccctggccctgacccagaccwgggcrggctcycavtccatgaggtrtttcwhcacmtccrtgtcccggcccggcmgyggrragccccgcttcatckcmgtgggctacgtggacracdcgcagttcgtgcrgttygacagcgacgccgsgagccngaggatggagccgcgrgcvccgtggatrgagcrggagrggccggagtattgggaccrgvagacacggmatrtgaaggcccagtcacagrctvaycgaghgrrcctggsgaycsygckcsgctactacaacsagagcgaggmcggtwctcacaccvtccagakratgtwtggcngcgacgtggggycggackggcgmytmctscrcgggtaysrvcrgkwcgcytacgacggcaaggattacatcgccytgaamgargacctgmgctcytggaccgcrgcrgacadggcrgctyagayyaccmagcrcaagtgggamrcsgyccrtbhggcggagcagydgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccasgacacggagctcgtggagaccaggcctgmmggggatggraccttccagaagtgggcgkctgtggtggtrccttctggavaggagmagagatamacctgccatgtgcagcatgagggtytscccragcccctcaccctgagatgggagcyrtcttcccagcccaccrtccmcatygtgggcatcmttgctggcctrgttctcyttgsagctrtgwtcrctggagctgtggtcgctgcygtgatgtggaggaggaagagctcagatagaaaaggagggagytacactcaggctgcaagcagtgacagtgcccagggctctgatgtgtccctcacagcttgtaaagtgtga

SEQ ID NO: 87 - DNA, 972 bp, Homo sapiens
aagcaacccagacttcatascagctcccaacaccatgacctgctgccagaccagcttctgtggatatcccagctgctccaccagtgggacatgcggctccagctgctgccagcmaagctgctgtgagaccagctsctgccagccaagctgctgccagaccagcttctgcggatttcctagcttctcaactagtgggacctgcagctccagttgctgccagccaagctgctgtgagaccagctgctgccagccaagctgctgccagaccagctcctgcrgaactggctgtggcattggtggtggcattggctatggccaggagggcagcagtggagctgtgagcacccgtrtcaggtggtgccgcccagactgccgtgtggagggtacctgcctgcccccctgctgtgtggtgagctgcacacccccaacctgctgccarctgcaccacgccgaggcctcctgctgccgcccatcctactgtggacagtcctgctgccgcccagtctgctgctgctactcctgtgagcccacctgctaaaagccagtttgctgattttcaacttgaaatwtccactttcagttccattcatgaacgaattatttcttcaagcacttatggacaacgarcaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaacaaa

SEQ ID NO: 88 - DNA, 1368 bp, Homo sapiens
ggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacamgttagcgcmgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccgggaccaccatcatggcagtggagtttgacgggggcrttgtgatgggttctgattcccgagtgtctgcaggcgaggcggtggtgaaccgagtgtttgacaagctgtccccgctgcacgagcrcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcrtataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaa

SEQ ID NO: 89 - DNA, 1576 bp, Homo sapiens
ggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacamgttagcgcmgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccgggaccaccatcatggcagtggagtttgacgggggcrttgtgatgggttctgattcccgagtgtctgcaggcgaggcggtggtgaaccgagtgtttgacaagctgtccccgctgcacgagcrcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcrtataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaaggccaggcgcggtggctcrtgcctgtaattccagcactttgggaggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggc

SEQ ID NO: 90 - DNA, 2493 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagygtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacaccttatacacatggcctgaagatttttttccttctctttttttctgagatcacaccattgcactccagcctgggtgacaaaaggaaaacttcgtctcaac

SEQ ID NO: 91 - DNA, 2155 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatggctctgtcagcctctctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaaygcctgtctccccgcggatcatgggctcctcgaggacagggacyggcctgtctgtccactgctgtaaccccgcgccggcatagggacctaaggcccactggagggcgctcatc

SEQ ID NO: 92 - DNA, 2465 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagygtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcamtcttccgcccaggctgcagtgcagtggcatgatcttggcttactgcaacctccgcctcctgggttcaagcaattctgtggcttcagcctccggagtagctgggattacaggcacatgccaccacacccagtgaatttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctcagaccgccgcgcgtccctcttgtgcggttcaccacagttgtatttaagtgatcgtgtgag

SEQ ID NO: 93 - DNA, 1296 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaaygcctgtctccccgcggatcatgggctcctcgaggacagggacyggcctgtctgtccactgctgtaaccccgcgccggcatagggacctaaggcccactggagggcgctcatc

SEQ ID NO: 94 - DNA, 2815 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacagtgagttgggggacagaggtctccaggggtagagggtgggcactggattgtggkkaccgtaatagggggagggatgatggataagaggrtgcctgggcaagtaagtagagatagaaagaggttcctgggagttagagggrtaatgggaggctagaagtttcctggaaatttgaggggctttgacatgggtatttctgtgacgcaccaatggagagacagtgggtwccctatttcaggagaagaaacctaaccttctttagttctgaggaagccagcaggcaaactgaggrtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagygtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcamtcttccgcccaggctgcagtgcagtggcatgatcttggcttactgcaacctccgcctcctgggttcaagcaattctgtggcttcagcctccggagtagctgggattacaggcacatgccaccacacccagtgaatttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctcagaccgccgcgcgtccctcttgtgcggttcaccacagttgtatttaagtgatcgtgtgag

SEQ ID NO: 95 - DNA, 3766 bp, Homo sapiens
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggctwmatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagygtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcamtcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaaygcctgtctccccgcggatcatgggctcctcgaggacagggacyggcctgtctgtccactgctgtaaccccgcgccggcatagggacctaaggcccactggagggcgctcatcaagtagctgctggatgttgacgaaggaarcggcggcgcagctcagggatctccgagtcaggacggtcggccagasccacggggtaacgggtctaatcgtgtaggaataaagctgtattccagtgcttccaaa

SEQ ID NO: 96 - DNA, 2523 bp, Homo sapiens
  misc_feature (1)...(2523): n = A,T,C or G, or insertion/deletion polymorphism (see Tables 1-2)
ggacgcggaacccggcgcggcggcggcacgatggtcatggcgtatttcgtcgagaattttagggggaaaaaaatagtggctttgatgtcctctaccataatatgaaacatggacagatatcaacaaaagaactagcagattttgtaagggaacgagctaccatagaggaggcatactccaggtcaatgacaaaactagcaaaatctgcaagcaattattcacaacttggaacatttgcaccagtatgggatgtattcaaaacatctacagagaaattagcaaattgtcacttggatcttgttagaaaattacaagaattaataaaggaagttcagaagtatggagaagaacaagtaaagtctcataaaaagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggcagctgttaaatctaagaaagctacagatacctataaactctatgtggaaaaatatgcattagcaaaagctgatttcgaacagaaaatgacagaaacagctcagaaatttcaagatattgaagaaactcatctcattcacataaaggaaattataggatccttgtcaaatgctataaaggaaattcatttgcagataggccaggtccatgaagaatttataaataacatggctaatactacagttgaaagtttgatacaaaaatttgctgagtcaaaaggcactgggaaggaaagacctggcctcattgaatttgaagaatgtgacactgctagtgcagttgaaggtataaaaccaaggaaaagaaagacctttgctttgccaggaatcattaaaaaggaaaaagatgcagaatctgtggaatgtcctgatgcagattcattgaacattcctgatgtagatgaagaaggctacagtattaaaccagaaacraatcagaatgataccaaagagaaccatttctactcatctagtgattctgactccgaagatgaagaaccaaagaagtatcggatagaaattaagcctatgcatccaaataactcacatcacacantggcttctttggatgaattaaaagtatctatagggaatataacactctccccagcaatatctagacacagtccagtaaatgaatcggaatttgtctaatgaggagttaacaaaatcaaagccatctgctccacccaatgaaaaaggaaccagtgatttacttgcttgggaccccctatttggaccatctcttgattcatcttcttcatcttcactaacttcatcatcatcagccaggcccacaactcctctttctgtaggcaccattgtcccacctccgaggcctgcttccagaccaaagcttacttcaggcaaactcagtgggattaatgaaatacccaggccattcagcccacctgtaacttccaacaccagcccacctcctgctgcaccatwagcccgggcagaaagttcttcttctatctcatcatctgcttcattgagtgctgccaatactccaacagtaggatttaacaagttaattgtgtatattctaggtgtgtcacggggtcccagccctgtcagccttggaaatcaggataccttacctgtggcagttgcccttacagaatctgttaatgcctactttaaaggagcagatcccaccaagtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcagtgatccatcacaatgtgattccaacacaaaagatttttggatgaacatgcaagctgttacagtctacctcaagaagctgtcagagcaaaatccagctgcttcttattataatgtagatgtattaaagtatcaggtatcatcaaatggtattcagtccactcctctgaatcttgcaacatactggaaatgtagtgctagcaccacagatcttagagtggattataaatacaatccagaagctatggtggcacctagtgtgctttccaacatacaggtggtggtaccagtggatggaggagtaacgaacatgcagtcccttccccctgcaatatggaatgcagaacaaatgaaagccttttggaaattgtctagtatttcagaaaaatcagaaaatggaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggacgatacctggcggattgttgatggacctgggaaagtgatgtggcttcagggatt

SEQ ID NO: 97 - DNA, 595 bp, Homo sapiens
ggctgtgcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgrgatccctcggtgaagaggactctctgtcgaggctgctcttccctcctcgtcccgggcctcacctgcacccascgccagagacgctgcaggggacagcgctggaccgtacagacctgcctaacatgccagcgcagccaacgcttcctcaatgatcccgggcatttactctggggagacaggcctgaggcccagctygggagccmagcagattccaaaccactacaacccttgccaaacacagcccactccatttcagaccgccttcctgaggagaaaatgcagackmagggttccagtaaccagtgatggattcaccycatctcccraataaagtttacttgttttacattccatgattctgttctgtgggtatttcaactcttaattcc

SEQ ID NO: 98 - DNA, 893 bp, Homo sapiens
  misc_feature (1)...(893): n = A,T,C or G, or insertion/deletion polymorphism (see Tables 1-2)
caggaaatcgagactcatgactcccagagaggatggcatctagaagtagacgatcaagggtggaatctacagtccrtgrgccctgacttcttgccttcgtctcaaatagactctgcagccagccatctatgcagcgccccagtggctttgaaatgcaacagaaaccatcacccccggaccrtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccraggaaactcgtcccccccacgttaatcctgaccgactttgccacatggagccagcaaaccatttctggcatncaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaaygtttccctcaaggacctttctgcctggaagtctgttagcctttcagaagtaacatgtccaaaataaaatttgattcctcccaggttgttccctgcctggtccgctaccccacagtaaggaacaccttattatgcaa

SEQ ID NO: 99 - DNA, 861 bp, Homo sapiens
  misc_feature (1)...(861): n = A,T,C or G, or insertion/deletion polymorphism (see Tables 1-2)
caggaaatcgagactcatgactcccagagaggatggcatctagaagtagacgatcaagggtggaatctacagtccatgggccctgacttcttgccttcgtrtcaaatagactctgcagccagccatctatgcagcgccccagtggctttgaaatgcaacagaaaccatcacccccggaccrtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggamcccagctccttaacacagatcccagctccraggaaactcgtcccccccacgttaatcctgaccgactttgccacatggagccagcaaaccatttctggcatncaggggacctccaagcaatgatatscaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctcyaactctattgtactcgtctcctccctcccattctccttttggtctcagctccttgatctaagcctcccagagagacccctagaaygtttccctcaaggacctttctgcctggaagtctgttagcctttcagaagtaacatgtccaaaataaaatttgattcctcccaggttgttccctgcctggtccgc

SEQ ID NO: 100 - DNA, 586 bp, Homo sapiens
tgcccagttcagaaaggtggcccgagggtatatggcaaggcccgtcaattcacccagctgggtaccggctgcctccacccctgcactctgctgtgggcagagtgtgaccaggcctggggggtgcgggggacagagactgggctcctgaggagtgggggtgggatatgaaccccccccagtcaccatcctgccggtcgcagagcactgcgtccgtgtgatgaacccccaccccagtcaccgtcctgtcggttgcagagcactgcgtccgtgtgatgaaccacccccagtcaccctcctgccggtcgcagagcattgtgttcktgtggaggacacgcgaggactcttggaagtgctttttggcggggtagtgcagtgtgttccgrgcggacgggcgtcagtttacgtgtgcgtttctcatccttgcagcctttagcttttgcaggatgagaccgggaggctcctgtggtcttggcctttgcctgggctgctgtcttcatccctggggtggcaatrcctgcctgcatcttgacgggcctcctgtcggctgctggaggagctgggagctctgtcaggtaaagagraaaaa

SEQ ID NO: 101 - DNA, 850 bp, Homo sapiens
tggaagttactttggtttcgaaaaggaacatgctgttctttctgagtgtttgcattcagcacaagaggaatccagaagtgatgcacagagaacaaactctgtccccatcccattcccagggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcrgacttracrccctgcaaggcccgaagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacaygtggaggttgctagacctgggatccagcccttctggtgtcacctcccagggtgactcaactccagagctcccagctcctccagcagccgacaggaggcccgtcaagatgcaggcaggyattgccaccccagggatgaagacagcagcccaggcaaaggccaagaccacaggagcctcccggtctcatcctgcaaaagctaaaggctgccagrggccccccaagatccgtaactacaacattatggactgacttcctccccccaccccgccccactaaggggtgctcggggcctccgcatggtgcctgtgctttcacctacrtgttgtgggggggtgtgggcacagcgtgcag

SEQ ID NO: 102 - DNA, 1045 bp, Homo sapiens
tggaagttactttggtttcgaaaaggaacatgctgttctttctgagtgtttgcattcagcacaagaggaatccagaagtgatgcacagagaacaaactctgtccccatcccattcccagggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcrgacttracrccctgcaaggcccgaagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacaygtggaggttgctagacctgggatccagcccttctggtgtcacctcccagggtgactcaactccagaacttcattctgtcctaaaggaagcagtcgcagcttaaagagtgtgagcacgcgcccactccccacagacacacccggcctgccccgccccacgctgcccctgccctggagaaagyraggctccttcctttcctggagacgccggccacagttcttcagtgaaacgcttcactctctggtcatagagagctcccagctcctccagcagccgacaggaggcccgtcaagatgcaggcaggyattgccaccccagggatgaagacagcagcccaggcaaaggccaagaccacaggagcctcccggtctcatcctgcaaaagctaaaggctgccagrggccccccaagatccgtaactacaacattatggactgacttcctccccccaccccgccccactaaggggtgctcggggcctccgcatggtgcctgtgctttcacctacrtgttgtgggggggtgtgggcacagcgtgcagggtggagg

SEQ ID NO: 103 - DNA, 2299 bp, Homo sapiens
agcagctcatcgagatggggaacaggctccgtgcagagctgggccgacccgaaaggtggctgttgcaccacgccctccctcctgcccctgaggcccggaagccaggcgaggagcccaggaggcctttggatcgcagcccacctttgggacaggtgcagccccattttacatctcaggacgccaagagtgccgaggatgaggctccttccagacacttgggaaagcaccagccccgctcagcacaggtgggcagcrgacttracrccctgcaaggcccgaagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacaygtggaggttgctagacctgggatccagcccttctggtgtcacctcccagggtgactcaactccagaaatggggtctcactatgtcacccaggctggtctcgaactcctgggctcaagcagtcctgccgccttggcctcccaaagtgctgagatgacaggtgtgggccccacgcccagcctggcgtggagtggagcccttcacccaaacatgaaccaggaggcgagcttggtaaggagcgcgtgggctccaggaatgcgagggggaatgaatggaggcagctcctcagtgtgcaaaaacatgcagcgcgggcctcactggtcaccatcacagcagccttgcagtgggatcaggacagtcctgctgtccaggaaggagaggaccctgctctcttgtttctcactacctgctcctgtcgttctagtcccattgctgctctcaggacaagctgtgactgagagagcaggtcacgctggtgacattttatgaggctggatgcacagccccacagcaccttgtcactgaagctacaggaatccaagaaccagtgctctggccaagaagggagcactggggtgccctgaatggcacggacaaccccagccccccgccttcactgattatcatgacctgtggcttctgaaaggacagggcagtcttggaactttctgagaaacagatggtcaagtagatgtctgttagctcttttcttgaaattgtagtgacgaaaccatgactgccacttaggaaagtaacttgtgttgaaataacttttagaacaaagtaaatacattaagaaataaccaaatcggcttactttctgataatatttattctatgcccacacaacggctggcactcacttctgcttctggccaggccgtagttacaaggaccagactttaatgttcctccatgaacaactagaaaactggacaaagtatatgaaacaactgtttgcagacattggacaactggtcaaacaagaccgagatccccaacaagaccgagaccctggacgagtccgagatcccggacaagaccgccacccttgttggaagggagacaggcaaggtgaaccctggggccctggccttctgcctgaaggccgtttctgggctgccggcacagggagggaagcagggcctgagcaaagctgagcacccttacggagctgagactgcactagggtctggggacacagaaggagccggcatttcagggcagaatcccgcaaggaggaaactgcagaaaagagctccagaaatctgcacagggttctcttgagtctgtactgaggaccagcctgtacatgtatagaagaaaactccacaaagccaggcaaagaggagaaaggagcatgtaaggtgaacaacttccagacctcgcacacggtcatgacatactgaagctccagccagggggatgggtccccagtgatcactgtggacattcagtggagactcaggaggagccacaccgtgggaacagggctgatgctgtctgcagtgaaggctcgtctagaacctgcctgagaaactgcagctacagaaatccaaggcctggcatggcggctcacgcctgtaatcccagaactttgggaagccgaggtgggcagatcacctgaggccaggagttcacaaccagcctggtcaacttggtaaaaccccgtctctactaaaaatacaaaaattagtcaggtgtggtggtgcatgcctgtaatcccagctactcaggaggctgaggcatgagaatcacttgaacctgggaagcagaggttgcagtgagccgagatcgcgccactgcactctagcctgagtgacagagcagactcctgtctcaaaaaaaaaaaaaaaaaaaaaaaaaaa

SEQ ID NO: 104 - DNA, 3335 bp, Homo sapiens
atgagtgataatccacccagaatggaagtgtgtccttactgtaagaagccatttaaacgattaaaatcccacttgccatactgtaagatgataggaccaaccatacctactgatcaaaaagtttatcagtccaagccagcyacactcccacgtgctaaaaagatgaaaggrccaatcaaagatttaattaaagctaaagggaaagagttagagacagagaatgaagaaagaaattctaagttggtgrtggacaaaccagracagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttaygcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactrgtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaamagcaggaacggactgtcatgagccatggctgtgagaacttcaacaccagggattcagtcacaggaaaggagtctcaaggggaaaraccacatttaagtttgytcattccgagggagacgacttaccagtttcattctgtatcrcagtcaagtagtcaaagtcttgcctctctagctacaacatttcttcaagaaaagaaagcagaagcccagaatcatmatygtgtccctgatgtaaaggcattaatggagagtcccgagggacagttatctctggagcccaaatctgatagtcasttccaagcatcacacactgggtgccagagccctttatgttcagcccagcgtcacactcctcagagccccttcaccaatcatgctgcagctgctggcaggaagactcttmgcagctgcatggggctggagtggtttccagagctctatcctggttaccttggactaggggtgttgccagggaagcctcagtgttggaatgcaatgacccagaagccacaacttatcagtccccagggggaaagactctcrcaaggctggatcaggtgcaacaccaccataaggaagagtggattcggtggcatcackatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttygtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaastgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaaygcttagatcttgcttccaggcagcagcttgaattcccgaatcttcctgcaaggtgcatacaaatgcagcgtkagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgtaaaatat

SEQ ID NO: 105 - DNA, 2075 bp, Homo sapiens
ggggcttccctggggggcttgtcgccggggccgcctgggctttcaggtcttccgaggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagcyacactcccacgtgctaaaaagatgaaaggrccaatcaaagatttaattaaagctaaagggaaagagttagagacagagaatgaagaaagaaattctaagttggtgrtggacaaaccagracagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttaygcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactrgtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaamagcaggaacggactgtcatgagccatggctgtgagaacttcaacaccagggattcagtcacaggaaaggagtctcaaggggaaaraccacatttaagtttgytcattccgagggagacgacttaccagtttcattctgtatcrcagtcaagtagtcaaagtcttgcctctctagctacaacatttcttcaagaaaagaaagcagaagcccagaatcatmatygtgtccctgatgtaaaggcattaatggagagtcccgagggacagttatctctggagcccaaatctgatagtcasttccaagcatcacacactgggtgccagagccctttatgttcagcccagcgtcacactcctcagagccccttcaccaatcatgctgcagctgctggcaggaagactcttmgcagctgcatggggctggagtggtttccagagctctatcctggttaccttggactaggggtgttgccagggaagcctcagtgttggaatgcaatgacccagaagccacaacttatcagtccccagggggaaagactctcrcaagtttctttgttggaacgaagctcaactcatataaggagtttggaaccccctrccggacttacaacctccaacttctctctaatgaggctcttgggagctgtacaaaaaggctggatcaggtgcaacaccaccataaggaagagtggattcggtggcatcackatgctcttcacaggatacttcgtcctgtgttgtagctggagtttcagacgtctgaagctgcagcggtggcgtaagtagtgttgacctggacatcacttaaagctctggaacagcaaagggcgtacagtggagacgactgcaatacatacttaacagtttaaaaatgtataatatttgggacagggagaggggagtgaaaaaaataaagaataaaattattggaatctaaaat

SEQ ID NO: 106 - DNA, 3630 bp, Homo sapiens
cgactaggagcttctgggagaaaggacctcccctggggtggcagaagcgctcgcctgttcacagccaacggagggctgacattcacgtttcattctgccacactcgggaacggtgatcggggaagcatggggatccgggagaagcacccacaaaactagcatcctcctggaggagctcgggaataggatgagtgataatccacccagaatggaagtgtgtccttactgtaagaagccatttaaacgattaaaatcccacttgccatactgtaagatgataggaccaaccatacctactgatcaaaaagtttatcagtccaagccagcyacactcccacgtgctaaaaagatgaaaggrccaatcaaagatttaattaaagctaaagggaaagagttagagacagagaatgaagaaagaaattctaagttggtgrtggacaaaccagracagacagtgaagacctttccactgccagctgttggtttggaaagagcagctactacaaaggcagataaagacatcaagaatccaatccaaccatccttcaaaatgttaaaaaatactaaaccaatgactactttccaagaagaaaccaaggctcagttttaygcatcagagaaaacctctcctaaaagagaacttgccaaagatttgcctaaatcaggagaaagtcgatgtaatccttcagaagctggagcgtctttactggttggctcaatagaaccttctttgtcaaatcaagatagaaaatattcctcaactctacctaatgatgtacaaactacctctggtgatctcaaattggacaaaattgatccccaaagacaggaacttctagtaaaattactagatgtgcctactrgtgattgtcatatttctccaaagaatgtcagtgatggggttaaaagggtaagaacattattaagcaatgagagagattccaaaggcagggatcacctctcaggagtccctactgatgttacagttactgagactccagaaaagaacacagaatccctcattttaagccttaaaatgagctcattaggtaaaatccaagtcatggagaaacaagagaaaggacttaccctgggagtagagacgtgtgggagcaaaggaaatgcagagaaaagtatgtctgcaacagaamagcaggaacggactgtcatgagccatggctgtgagaacttcaacaccagggattcagtcacaggaaaggagtctcaaggggaaaraccacatttaagtttgytcattccgagggagacgacttaccagtttcattctgtatcrcagtcaagtagtcaaagtcttgcctctctagctacaacatttcttcaagaaaagaaagcagaagcccagaatcatmatygtgtccctgatgtaaaggcattaatggagagtcccgagggacagttatctctggagcccaaatctgatagtcasttccaagcatcacacactgggtgccagagccctttatgttcagcccagcgtcacactcctcagagccccttcaccaatcatgctgcagctgctggcaggaagactcttmgcagctgcatggggctggagtggtttccagagctctatcctggttaccttggactaggggtgttgccagggaagcctcagtgttggaatgcaatgacccagaagccacaacttatcagtccccagggggaaagactctcrcaagtttctttgttggaacgaagctcaactcatataaggagtttggaaccccctrccggacttacaacctccaacttctctctaatgaggctcttgggagctgtacaaaaaggctggatcaggtgcaacaccaccataaggaagagtggattcggtggcatcackatgctcttcacaggatacttcgtcctgtgttgtagctggagtttcagacgtctgaaaaaattgtgccgacccctgccctggaagagcacagtacctccatgcattggtgtggcgaagacgactggggattgccgctctaaaacatgtttggattaggaagcacgtttaagtaggagaagccttygtgacttctctctagtgccttcgtgccctgtgttgcccactgaattgccctgtaacacctaagtgtagtggtagcattaagggatagcttttcagccctcaaggttatcaggagcatttgtatcactgctataaataaagtagtatcacttgtcataatcagggtgctgaaacataatgaaaaggtttaacttagtcacagtaaatattttatatccctgaaaataagttatttaatgagaatagaactatttaatgatccatgagtcctaaaaggatatctgccttgtattgccaagtttaaggcaaaggtgagatcctgtattaataagaagacagcttttttgtttgacattggtaagtaccaagaattctaactcacatatagtaggaaacaacaaaaagtctccactgacttctttgaattagatactgagaatccacaatacagtagtgtggataactttcaagaagccattggaaacatctccacattctgggatgacttgtaaatgtctacagagtaatggaaggaaaggcttccttgtctgctcattgctgccacctgggttgggaaaataattgaagatgttttctcaagtccttcaagaatctcttcttaatgttcagaatagtttaagagcgttgttgaggtaaastgatagctgattattttctgagatttagatctaaacaaactcagcatgacgaggaagcacacttcacagctccagggtgcaatactgatgtaaagttgcctcgtgaggatacatttttcgctcatgtatgcaaaattcctatcagttcatttgcacagccagttccaatcatgtatgtgatcaccagattaaaagcttcatccagaaagacaagactcctcagaacgaatagtagacaagtaagactgctacccacagaagccagtacgcttcaggtgtgaggcggggtaactactcatctcttcacagagccaaggaaagaaaaagaacgtctctaacatgatttaccattttaaacagccttataagttttgtctcttaaaatcatgctgcagaaggagggggtaaaagtcgtgttctgccctgtctgtggcattggagtgccccgctaggtaagaagcaaygcttagatcttgcttccaggcagcagcttgaattcccgaatcttcctgcaaggtgcatacaaatgcagcgtkagaatccatacacgtaatccatattcaccttcccatccatcccgcagaagaggcatggtgacacccaggctactgtccatgcttgagaggacgtatttgaaggttctgttactacaagttgggaatattcacggacatgcctgaataccccggctgtaactcacacgtggtctgtgtaagtggattaacctcggggcggccttgtttaatcctgaataatatctgaaagactgagtttacttgggaatgtgtagtttttctaatgcacattaaaatttattttagctgttaaaaataaaatcattttattatcagcagactcttttatactttatggggcatctacatactacttccgccactcttcataataaaattatttgtaaaatat

SEQ ID NO: 107 - DNA, 364 bp, Homo sapiens
  misc_feature (1)...(364): n = A,T,C or G, or insertion/deletion polymorphism (see Tables 1-2)
ctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcantgcgtcagagtttcaggta

SEQ ID NO: 108 - DNA, 2166 bp, Homo sapiens
gccacactcccatcatttgcttaggtctgatcaatctgctccacrcaatttctcagtgatcctctgcatctctgcctacaagggcctccctgacacccaagttcatattgctcagaaacagtgaacttgagtttttcgttttaccttgatctctctctgacaaagaaatccagatgatgcragacctgatgaagacaatacatggaaaatgacagtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtggtaaattattgttttcagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacytccttccagaactgcaggagccatgatgcaattcacagcccctattcccggagctacaggacctatcaagctctctcaaaaaaccattgtgcaaactcyaggacctattggtaagctgcctctggtccaccttcagcaccccgcggtccacccatggcacccataataatttcacagagaaccgcaagaatacctcaagttcacactatggacagttctggaaaaatcatatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttacgaattctgtagaatcctkgaaatcagcacacataaaggagycagaaagagaaggaaaaggcactgatttagagaaagacaaaataggaatggaggtcaaggtagacagtgacgctggaataccaaaaagacaggaaacccaactaaaaatcagtgagatgagtrtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtsagtctggtgtctcaaagggacaggaagcccaggtaaagmagagggagtcagttgtactgaaaggacaggaagcccaggtagagaagagtgagttgaaggtaccaaaaggacaagaaggccaagtagagaagactgagrcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaatt

SEQ ID NO: 109 - DNA, 2150 bp, Homo sapiens
gccacactcccatcatttgcttaggtctgatcaatctgctccacrcaatttctcagtgatcctctgcatctctgcctacaagggcctccctgacacccaagttcatattgctcagaaacagtgaacttgagtttttcgttttaccttgatctctctctgacaaagaaatccagatgatgcragacctgatgaagacaatacatggaaaatgacagtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtgacacttcatrtgataaccgaggtaagtatatgtagagatttttcaccatcaaccaactctctagcactgtctcgatcaagtattgctttacctcaaggatccatgagtagtataaaatgtttacaaacaactgaagaacytccttccagaactgcaggagccatgagtaaccggagctacaggacctatcaagctctctcaaaaaaccattgtgcaaactcyaggacctattggtaagctgccttcagatcgcatcctcacacaatcactggtccaccttcagcaccccgcggtccacccatggcacccataataatttcacagagaaccgcaagtcagctggcagcacctataagaatacctcaagttcacactatggacagttctggaaaaatcatatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttacgaattctgtagaatcctkgaaatcagcacacataaaggagycagaaagagaaggaaaaggcactgatttagagaaagacaaaataggaatggaggtcaaggtagacagtgacgctggaataccaaaaagacaggaaacccaactaaaaatcagtgagatgagtrtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtsagtctggtgtctcaaagggacaggaagcccaggtaaagmagagggagtcagttgtactgaaaggacaggaagcccaggtagagaagagtgagttgaaggtaccaaaaggacaagaaggccaagtagagaagactgagrcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgttttataagttaagacgtatatgattccgtcaagaaagactggatactttctgaagtaaaacattttaattaaagaaatatatagtaatt

SEQ ID NO: 110 - DNA, 2222 bp, Homo sapiens
  misc_feature (1)...(2222): n = A,T,C or G, or insertion/deletion polymorphism (see Tables 1-2)
ctgctccacacaatttctcagtgatcctctgcatctctgcctacaagggcctccctgacacccaagttcatattgctcagaaacagtgaacttgagtttttcgttttancttgatctctctctgacaaagaaatccagatgatgcragacctgatgaagacaatacatggaaaatgacagtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacytccttccagaactgcaggagccatgatgcaattcacagcccctattcccggagctacaggacctatcaagctctctcaaaaaaccattgtgcaaactccaggacctattgtacaatatcctggacccaatgctggtccaccttcagcaccccgcggtccacccatggcacccataataatttcacagagaaccgcaagaatacctcaagttcacactatggacagttctggaaaaatcacactgactcctgtggttatattaacaggttacatggatgaagaacttgcaaaaaaaccttgttccaaaatccagattctaaaatgtggaggcactgcaaggtctcagaatagccgagaagaaaacaaggaagcactaaagaatgacatcatatttacgaattctgtagaatcctkgaaatcagcacacataaaggagycagaaagagaaggaaaaggcactgatttagagaaagacaaaataggaatggaggtcaaggtagacagtgacgctggaataccaaaaagacaggaaacccaactaaaaatcagtgagatgagtrtaccacaaggacagggagcccaaataaagaaaagtgtgtcagatgtaccaagaggacaggagtcccaagtaaagaagagtgagtcaggtgtcccaaaaggacaagaagcccaagtaacgaagagtgggttggttgtactgaaaggacaggaagcccaggtagagaagagtgagatgggtgtgccaagaagacaggaatcccaagtaaagaagagtsagtctggtgtctcaaagggacaggaagcccaggtaaagmagagggagtcagttgtactgaaaggacaggaagcccaggtagagaagagtgagttgaaggtaccaaaaggacaagaaggccaagtagagaagactgagrcagatgtgccaaaggaacaagaggtccaagaaaagaagagtgaggcaggtgtactgaaaggaccagaatcccaagtaaagaacactgaggtgagtgtaccagaaacactggaatcccaagtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttyataagttaagacgtatatgattccgtcaagaaagactggatactttctgaagtaaaacattttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 111 - DNA, 4530 bp, Homo sapiens
cctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagytgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaagsatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcrgaggtaattaagaatcgttttcatcgtgtgttcctaccctcccactcactggacactgtgtccccatctgatacgctcctctgctttgagctgctatcctcaragttggctaaggagcgggtagtggtgctagaggtgcaacaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacatyggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaagctgctgtgcctgggtaccagcatccaagtgaagctwtgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgct

SEQ ID NO: 112 - DNA, 4572 bp, Homo sapiens
cctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagytgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaagsatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcrgaggtaattaagaatcgttttcatcgtgtgttcctaccctcccactcactggacactgtgtccccatctgatacgctcctctgctttgagctgctatcctcaragttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacatyggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaagctgctgtgcctgggtaccagcatccaagtgaagctwtgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgct

SEQ ID NO: 113 - DNA, 2228 bp, Homo sapiens
acttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagactwgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaarctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctscctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtggggtattttatctctcctttcatcctttttagtctttctaagattatgagacttttctatattacattcaaggtcatgtttttatttggcaagattgtggtttcagaatgaggaaaagctgtggggaccaaagctaacttgtttgtcttactgactttttcagggccatgttggaattgtccttgctcacatgctgccatcatgtcaggtaaagccagaataagagataaaaggaaatattttaaaattatacagtkcagctagccaaatttggtttatcccgctcttggagtttctagtcactcacccaagtcaaatatgtggcacaggcattgtcttttctttgaaataaactttcaagactcagaatcttaaggaaaaaaaagtaaagtaagatcataaaacatttatcaatttttaaaagaggtttataggtttaagtaatttttcaaagaagtagctattttattgctaaataaaataattatgattcaactagtttaattttcaatataattttaaatggaaatattgacctctgaaacttgctgagcatattcttttggtatcttgattttgatccattgcatcaaaattataacaatagcaaaattttttaaagc

SEQ ID NO: 114 - DNA, 2984 bp, Homo sapiens
acttccctttttccggtccgccggattatgaatgacggccggcgcgagtattttccacataaggtggctgtcgtttttctcctggcgtctgtggaggcgagtggtctgcgggcagcagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagactwgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaarctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttctgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctscctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaagtgatgaactgggtttaagcaacatttggttcattcaagcaaatatrgaatattttactgggatgtttaatattggagtagcattgcatgcttgtggagtggcaacagacatggtgattgagcactgtatcaaaacacgggcttccttcgtcacatgcccttgctgttatggtttcattcagaacacctcaaagttcaattttccaaaaagatcacaaggtcaggagttcgaaaccagcctggcyaacatggaacacatgattctgtgcagatttgcagaccagacagctgtccagctcccaccccaacgaaggctcataggaaaacagtgcatgtgcttggtggatctggatcgagcaagagctgcagaagaaygtggatactccgttcaagtgatatccatggagccagagagctgctctcccaaaaataacatgattgtgggagtccccatttaaaatgagatattcacatttgatattttgccatccgtcttcacgttggatgcccagtggcattcaggaggttcttggcataactaggaaacagcattagccatcttgaacctattgtgctcaggaaggaaagcaacagggaaatcttggaagtaaaggctccctgcaaagcatcacaaatgctttacaatgtgtgattaaaggactgctggtttttatagtgagaatcccctgaagtctcagctgccaaaagaataatactagtggaggttccatcacaggaataacaatttccttctcacttcacaagctcctctgatcttgccaatgtgatgtttaattcaaaacagcgcacttacagcctttattttatacttatttagatattcacatgggaactgaaagtagactcagtggagttttttgttttttatatttttaacaattgtactttttctatcactttaaaaaaatctagtcaggtaattatagtacagttatttttaagctggggttagttgaacttgtatagcatttaatatactccttttaaatatatttctgccaggcatggtggctcatgcctataatcccagcactttgagaggccaaggtgggaggatcatttgagcccaggatatcgagaccagcctgcactacaaaaaaatccaaaaaatgaggtgggaggatcacttgagcccaggaagtcaaggctgcagtgagccttgatagcgccactgcactcctgcctgggaaaacgagacccagactcaaaataaatcaatgaatgaattaataaacaaataaataaataaataaatttcc

SEQ ID NO: 115 - DNA, 941 bp, Homo sapiens
gggaaagatggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccargctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtrtgtgtctgcttggttgctacctcatgggggacatcacttgtgctcactgccatgctcatcctatccctgaggcttcacttctgtggggctaatgtcatcaaccattttgcctgtgagattctctccctsattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctmccctgaccaggacaagtttatctcagtgttttatggagctttgacacccatgttgaaccccctgatatatagcctgagaaaaaaagatgttaaacgggcaataaggaaagttatgttgaaaaggacatgagccttct

SEQ ID NO: 116 - DNA, 1811 bp, Homo sapiens
aagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcartgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatwcatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggwtatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagcsctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacrcasaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcagga

SEQ ID NO: 117 - DNA, 1947 bp, Homo sapiens
atgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctggcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcartgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatwcatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggwtatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagcsctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacrcasaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcagga

SEQ ID NO: 118 - DNA, 1709 bp, Homo sapiens
gcgccgccatgcttttgtacggcaggatcgcaaagcacgccgggaccggttggtttggttttgaagacgtggatggcgggaattctcgcttctggcctgggtgagctagaagggagaagcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcartgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatwcatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggwtatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagcsctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacrcasaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcagga

SEQ ID NO: 119 - DNA, 1871 bp, Homo sapiens
atagtataattatagctcccaattgagaggaaagagtatttctcttactgtttgcatataaaatcctaggagataactccagttggtctaacttagccaattcttccaaataggccttaagctgcaagaaagccggacatttcctcaactaagaaactgcagcaacayggtgggacaaaaaatggataataacctcctagaaaggatcactgtggagatcarcataactgagacttctggagacagctgcaaacaaggaagggcaagagctatttattggccatgcagtggttgccagcacatccccaaagactggctctgtggaggactctggtgatcttcatgcctgagacctccacagccctgtggcagccttgaactccttagttccctcctagtatttagtggaggcatatggaccccagtagcttgtgccatgaaagataccagcagctttcaccactgaggtagccaacagccaatgccaccttgtgtccttgggtgagggagatattgctgcactccctgactmccaagaaagagctgctcttgtaccaccctgggacaaggcaaccactcttgccaaccttgggcttaccctaaccgcaartggtggttgctctagaccctggctcctatgcagcctccccatctccagcctcagacaccagagccaatccacagcaggcgcctccacaccccttgctgtaactctgcttctgcccaggctctagacactaaattcayggctgcccaacaagctcccatgcctcatacaccattaccaaagaggcagtgggaggccctgcaccatgaaaacaaggrcctctgctgtctcagacccaggaggcctgaaactccgtgacagcctggttctagacatgggcttcctggccactccctgggcaccatgcatcaggcagtgtccctatcatataagcacacctgtgagctatacctggcaccaagagggattccttcttctaagacttcctctattggagaaaaacagatcaggacgacctcagcagtcttcaccacctaagaccccaacagctgtcctcaatgctgtggacataacagcattggccactgggaccctgcaatcttcagcatcactgccctcagctgatgtagctgcacctagactatgtagactatgcccaaatcagaacgggaaccacatcatcccacccagtgcacaaatagtcttaacacatttaagaaagttgaaatcatctagtatcttttccaaccacaatggtatgaaactagaaatcarcaggaggaaaactagaaagttcacaaatatagtcatgtgtagtataataacatttccrtcagggactaactgcatatactactgtggtcccattagatagtaatctagctcaaaaagtcctgtttcctagtggcatggcagcagcctaatgactcagcacaacacattaccttttctttgtttagatacacaaatacttaccattgtgttacaattgcccatagtattcagtacagtaacaggttgtacaggtttgtagcctgggagcaataggctataccatatagcctgtttgtgtagtaggctttatcttctagggttgtgtaagtactctctattttgttagcacaaatgacaaagtcrcctaacaatgcatttcgcaggatgtatccctgtcgttaagtgatgcagactgtttgtggaaatcaaacatcatacttctgaacatccaataggtcaaagaagaaatcaaaagagaaaatagaaaataagagaaatgaaaacaaaacacaacttaccaaaacttacgtgatgcagcaaaagcagtactaagaaggaaacacatagtgatattaaaaaagaagaaaga

SEQ ID NO: 120 - DNA, 6949 bp, Homo sapiens
  misc_feature (1)...(6949): n = A,T,C or G, or insertion/deletion polymorphism (see Tables 1-2)
tgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgaaagcaaaaaggaaagctttccacaaacctccacccacatcgccaaagtcaccttatctctctaagccragaaaagtggcctcctggaggtccctcaggacggcagggagcatgcctctgggcggccragcgtccctgaccccgcagaagctgtggctgggaaccgcaaagccaggaagtctgacccaggccctgaactcacccctcacctgggagmatgcgtggacnggcgtccccggyggcactcctgactgtctgacagacaccttcagagtgaagaggccacatctcaggcgctctgccagcaacggtcatgtcccygggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgcyctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagccygccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggytgtggtgcttcaggcagctttcaggggacatctcacgcggacaaagctcttagcaagcaaagcacatggctcagagccacccagcgtkccaggcctcccagaccagagctctcctgtgccccrcgttccragccccatcgcccaggccncgggcagccctgtgcaggaggaggccatcgtcatcatccagtccgctctgcgggcacacctggcccgggccaggcacagtgctaccggtaaaagaaccaccaccgcagcttctaccargaggagatcggcttcagccacacacggggacgcctcctccccacccttcctcgcagctcttcctgacccctcnccctcagggccacaggccntggcacctctacctggggatgacgtcaactccgatgattccgacgatattgtcattgcaccgtctctgcccaygaagaactttccagtttaggtccccgtcactgtctccacgcngtgatggcagcgctgccgaggacataggaaccacgactggaaagataatttatcgtgttaggagaagaacgatgatacctacttaacacctcagcatctgcgtcgtgtctctntgtgcttttgtttgtggaaggagacccaaatgcctttactttattctctggggagggccagcggctcgcatccccctcatctccagctgcagctcggatggtggattttcagtgccaacagacacatctgccgtgaactcgcakatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcsatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctsggcygggcygggctgggcygggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggncattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccrcctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggyaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaamcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctargaaagtagacaactcccgggggagacgaagtagagagtgagtccccaagaaagggactcctgccccagcgtcaagtgccaaagcaggccccatctaccacttcagggtcgacgttggtggcaggtrttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcaygtctgttgagctgacactgctgaggctgaagctggcccygtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttgganatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggccyggtgttgracraagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagnccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttaraattattctaactttatacataatgtataggccgatcttttggaagggataaggttttcattcttgtgcaactcattattctcattattggccttttaaataaaaagttgttttgcagtgtgccttgagtgccccgtgaagacttctctttaatgacctccaggtgtgttcctgccccacgcactcgggctgaacaaacgatccgcttcagaaaccccgcttctctgggcttctggcattttgccgtggtcgtaatgcaggcttggggttggagagccagctggagggacgggtcccgccgccagctccctgccacgcatgaactc

SEQ ID NO: 121 - DNA, 4894 bp, Homo sapiens
  misc_feature (1)...(4894): n = A,T,C or G, or insertion/deletion polymorphism (see Tables 1-2)
acccctcnccctcagggccacaggccntggcacctctacctggggatgacgtcaactccgatgattccgacgatattgtcattgcaccgtctctgcccaygaagaactttccagtttaggtccccgtcactgtctccacgcngtgatggcagcgctgccgaggacataggaaccacgactggaaagataatttatcgtgttaggagaagaacgatgatacctacttaacacctcagcatctgcgtcgtgtctctntgtgcttttgtttgtggaaggagacccaaatgcctttactttattctctggggagggccagcggctcgcatccccctcatctccagctgcagctcggatggtggattttcagtgccaacagacacatctgccgtgaactcgcakatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcsatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctsggcygggcygggctgggcygggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggncattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccrcctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggyaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaamcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctargaaagtagacaactcccgggggagacgaagtagagagtgagtccccaagaaagggactcctgccccagcgtcaagtgccaaagcaggccccatctaccacttcagggtcgacgttggtggcaggtrttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcaygtctgttgagctgacactgctgaggctgaagctggcccygtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttgganatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggccyggtgttgracraagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagnccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttaraattattctaactttatacataatgtataggccgatcttttggaagggataaggttttcattcttgtgcaactcattattctcattattggccttttaaataaaaagttgttttgcagtgtgccttgagtgccccgtgaagacttctctttaatgacctccaggtgtgttcctgccccacgcactcgggctgaacaaacgatccgcttcagaaaccccgcttctctgggcttctggcattttgccgtggtcgtaatgcaggcttggggttggagagccagctggagggacgggtcccgccgccagctccctgccacgcatgaactc

SEQ ID NO: 122 - DNA, 6919 bp, Homo sapiens
  misc_feature (1)...(6919): n = A,T,C or G, or insertion/deletion polymorphism (see Tables 1-2)
aggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgagtcaccttatctctctaagccragaaaagtggcctcctggaggtccctcaggacggcagggagcatgcctctgggcggccragcgtccctgaccccgcagaagctgtggctgggaaccgcaaagccaggaagtctgacccaggccctgaactcacccctcacctgggagmatgcgtggacnggcgtccccggyggcactcctgactgtctgacagacaccttcagagtgaagaggccacatctcaggcgctctgccagcaacggtcatgtcccygggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgcyctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagccygccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggytgtggtgcttcaggcagctttcaggggacatctcacgcggacaaagctcttagcaagcaaagcacatggctcagagccacccagcgtkccaggcctcccagaccagagctctcctgtgccccrcgttccragccccatcgcccaggccncgggcagccctgtgcaggaggaggccatcgtcatcatccagtccgctctgcgggcacacctggcccgggccaggcacagtgctaccggtaaaagaaccaccaccgcagcttctaccargaggagatcggcttcagccacacacggggacgcctcctccccacccttcctcgcagctcttcctgacccctcnccctcagggccacaggccntggcacctctacctggggatgacgtcaactccgatgattccgacgatattgtcattgcaccgtctctgcccaygaagaactttccagtttaggtccccgtcactgtctccacgcngtgatggcagcgctgccgaggacataggaaccacgactggaaagataatttatcgtgttaggagaagaacgatgatacctacttaacacctcagcatctgcgtcgtgtctctntgtgcttttgtttgtggaaggagacccaaatgcctttactttattctctggggagggccagcggctcgcatccccctcatctccagctgcagctcggatggtggattttcagtgccaacagacacatctgccgtgaactcgcakatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcsatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctsggcygggcygggctgggcygggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggncattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccrcctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggyaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaamcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctargaaagtagacaactcccgggggagacgaagtagagagtgagtccccaagaaagggactcctgccccagcgtcaagtgccaaagcaggccccatctaccacttcagggtcgacgttggtggcaggtrttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcaygtctgttgagctgacactgctgaggctgaagctggcccygtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttgganatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggccyggtgttgracraagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagnccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttaraattattctaactttatacataatgtataggccgatcttttggaagggataaggttttcattcttgtgcaactcattattctcattattggccttttaaataaaaagttgttttgcagtgtgccttgagtgccccgtgaagacttctctttaatgacctccaggtgtgttcctgccccacgcactcgggctgaacaaacgatccgcttcagaaaccccgcttctctgggcttctggcattttgccgtggtcgtaatgcaggcttggggttggagagccagctggagggacgggtcccgccgccagctccctgccacgcatgaactc

SEQ ID NO: 123 - DNA, 3059 bp, Homo sapiens
ggaaackttgagacagagcgcttggcacagaagtagcggggtcagggcgaagtcccagggcctcaggcmtggctctcaggatctcaggccccaaaggcggtgtatggattggggaggcccagcgctgggsattccccatctyygcagggtttctcttctccctctcccaacctgtgtcgggtccttcttcctggmtactcaccmggctgccccagttctcactcccattgagtgtcgggttyctagagaagccaatcaatgtagccgcggtcccggttctaaagttcccacgcacccaccgggactccgattctycccagtcgccgaggatggtgtcatggcgccccgaaccctgcttctgctgctctcgggggccctggtcctgacccagacctgggcaggtgagtgcggggtcgggagggaaacggcstctgtggggagtagctagggkcctgcccggcgggggckcaggaacccggttgcggtgccgggaggagggtcgggagvgtctcagccccctccttgctcccaggcttccactccttgaggtatttccacaccaccatgtcccggcccggccgcgcggatccccgcttcctctccgtgggcgacgtggacgacacgcagtgcgtgcgsctcgacagcgacgccacgagtcccaggatggagccgcgggcgccgtggatggagcmggaggggccggaatattgggaagaggagacagggaccgccaaggccaaagcacagttttaccgagtgaacctgcggaccctgagcggcyactacaaccagagtgaggcctgtgagtgacaccggccgggggcgcagvtcactacccstcyacatcccccacgraccgcccgggtctccccgagtctctgggtccgagatccacgccgaggcagcggvacctggagacccttbacccgggagaggcccaggagccgttacccggtttcattttcagccaaaatccccgcaggttggtcctggcgdgggcggggctcggtgggcggggctggccgcgggggcggggccagggtctcacacccatctagaggatgtctgtctgcgacgtggggtcggacgggcgcctactccgcgggtatcaccagcttgcttacgatggcaaggatthcatcgtcctgaacgaggacctgtgctccttgacagccgcagacacggcggctcagatcacccagctcaagtgggaggcggcccggggggcggagctgctcaaaacctacctgccsggaaggtgggcggagtggctcagcaaaggccttaagaatgagaaggagagkctgcaatgcgcaggtaccagaggccacgggkcgcytccctgatctcctgcagatatccctgagccaycttccaaaagaagggcaggaaaatgggaccaacgctaaaatatccctctccctcttgtcctgaggcagaagagtcctcctgggtttctaaatcctataccagagagtgactgagggcccgccctgcactctgggacaattaacggatgaagtctctgcgggaaaggaggggaagacaatccctggaatactgatacgcggtmccctttgaccccccagcagccttgggcaccaggaattttcctctcaggccttgttctctgcctcatactcaatgygtgtgggggtctgattccagctcttctgagtccctcggcctccactcaggtcaggaccagaaatctctgtttccgcctcagacactagaactttccaaggaataagagattatcccaggtgcctgtgtccagaatgytgtctgggttctgtgctcccttccccaccccagdtgtcccdtccattctcaggatggtcacatgggtgctgtgtctcatgaggaatgcaaagtgcctgaattttctacctcttgccctcagatcccctgaaggcacaggtaacccwccaccccatctccaactatgaggccacgctgaggtgctgggccctgggcttctaccctctggagrtcacactgacccagragcsggatggggaggaccaaattcaggatgcagagtttgtggagaccagacttgcagggtacagaaccttccagaagtgggcagctgcagtggtgtcttctggagagaagcagaggtacacatgccatgtgcagcaygaggggttgcctgagcccctcacactaagatggggtaaggagacgaatgagvggtcatgtctcttctcaggcaaagcagaagtccttctggagcctttaagcagggtcrgggctgaggcctgggggtcagggcccctcacgttcacctcctttcttagagctgtcttcccagcccatcatccccgttgtgggcatcattgctggcctggttcttcthgttgctgtawtcactgtagctgtrgtcgctgctgtgatgtggaggaataagatcccaggtaggaaaggggtgagctctgagtttccttcttccattggtggatttcaagccccaggtaggagtwggctcatatcttgcctagttgtgaggcaccatctccacacacatttaccctgttcagaggccctgtctatcaacvcttactcttttgtaaagcacytgtgaaaatgaaggacaaatttatcaccttgattgtggtcatgggaacctgactcccagcagtcacaggtcaggggaaggtccctgctgaggacagacctcaggaggacaaytggtccagcctcaacacatcctcttccctygggttttctgatcctgacctgggtctgtagtcacagttctggaaactyctctaggatctcatgccctgcctcctccctggcctctcacagtttgttttctttccacagatggaaaaggaggcagttatgctcaggcttcatgtaagtgtggtaggggtgggaagagtgatccctgagatccttgggatagtgtagacaggagcccatgggggagctcagccaccccaaaattcctcctttagtcacatcacctgtgggctctgaccagattttgtttttgttccaccccaaacaggaasagtacccagggctctgatgtgtctctcahggct

SEQ ID NO: 124 - DNA, 1200 bp, Homo sapiens
atggccatgaagggccagtctgtcaccctcattgttgactgcaagatttgttctmatatcttccagtattctctgtcagttggactgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatmtgggagaattttgaaayggatcattgctgtcaggatgaaggctgcccatgggccccggggkctgaagggaragaagagagagcctgcagtgctggaacctgtaagtyatgctggtcacagggctgaggtggtggaaagaggagaagcaacagaccatgtgtcaacatatgcggagtttgtgcagacgcacagaccctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatggcactgcctatagctgcctgttcctctcagaggggtattgctggcatcgtcatggcaaggaagcacttgaacacccggatcaatgcccccaccgaggtaagcgtctttcccaaggagcctgtggatctgggccagcccaacaccctcgtctgccatgttgacaagttcttcccaccagtgctgaacatcacgtggctgcgcaatggggagccagtcattgagggtattgcagagaccatcttcctgcccagcaagaaactcagattacacaggttccactatctgaccctcgttcccatggccgaggacacctgtgacctccagggggagcactggggcctgcaccagcctctcctcaggcactgggaggtccatgaamtaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcatcctataggtgtattagggacagagtggaaaagacgagg

SEQ ID NO: 125 - DNA, 730 bp, Homo sapiens
atgagtggtgtcataaagctcccaagagtttacgtcttttgtgattggctaccagcagaccatgtgtcaacatatgcggagtttgtgcagacgcacagaccctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatgcccccaccgaggtaagcgtctttcccaaggagcctgtggatctgggccagcccaacaccctcgtctgccatgttgacaagttcttcccaccagtgctgaacatcacgtggctgcgcaatggggagccagtcattgagggtattgcagagaccatcttcctgcccagcaagaaactcagattacacaggttccactatctgaccctcgttcccatggccgaggacacctgtgacctccagggggagcactggggcctgcaccagcctctcctcaggcactgggaggtccatgaamtaatccaggtgcctgagaccatggagatgctggtctgtgccctsggcctgctggtgggcctggcgggggtccttaatggcaccattgtctcaaagaccaagcgatctgacagcatccccgggtccaggggctccta

SEQ ID NO: 126 - DNA, 1878 bp, Homo sapiens
  misc_feature (1)...(1878): n = A,T,C or G, or insertion/deletion polymorphism (see Tables 1-2)
gtttttgtgctcccagctgtttggaaaagccgccggtatttctccacctggctctcctctacctccaggcaggcgcacccgaggtccccctcccaccccaccttctgccctcccgcacacttggaccagtgctgttgacccggaagcggacatttctgcagctattctaagcacacgtcggcggagggagcgggacgtggccagcggtcagcggcgaaggaggcaggccctgcgcggggatcacggaagccctgtgattcaccatgaagttccagtacaargaggtccatccctttgagtatcggaaaaaggaaggagaaaagatccggaagaaatatccggacagggtccccttgattgtagagaaggctccaaaagcaagggtgcctgwtctggacangaggaagtacctagtgccctccgaccttaccgatggccagttctacsttttaatccggaagagaatccacctgagacctgaggacgccttattcttctttgtcaacaacactatccctcccactagtgctaccatgggccaactatatgaggacagtcatgaggaagatgattttctgtatgtggcctacagtaatgagagtgtctatgggaaatgagtggttggaagcccagcagatggaagcacctggacttaggggtaggggaggggtgtgtgtgtgacttggggaaagagagggcggctcccaccgrgaggagacagaaggtgaagacatatagaaactttacaccgcacacaccgtcaacgcattttcacatgctcaactgatattttttgttgcttccttggcccagggagaaagcatgtcaggacagagctgttggattggctttgatagaggaatggggatgatgtaattttatggcattcctgagatttaatttttgtgcagtttcatagaaaggtcggtcaggaggtggacaagttggggtcagagatgatggcagtccagcagcaactccctgtgctcccttctctttgggcagagattctgtttttgacagttgcacaagacaggtagggaaaggggacttgtggtagtgggccatacctggggacgaaaagagacccactgtaattgatgcatcgtggcccccgatcttccgtrtcccacacttcttttctcccatcccagttgcaatctcactcacaaacatcacagtaccaccccaggggcggcagtagacaccarcccagaaatttagacagggatctcttatctttggaaaataggggttaggcatgagggtggttatgattaagaagataattttgttgttaaatagcattaaactggaattgacagagtgagttgagcanctctgtctaacctgctctttctctctggtgctcctcatctcacccctaccttggaatttaataagcttcaggcatttccaattgcagactaaaaccacttctaccatctcctctagtattttccatgtatcaggacagagatgtcttatgtagggaaggggcaggtatgaagtgaggtagattatctatacctctcactcattcaggattctcgctcccatgctgctgtcccttcaktctcacactcacaggaatgctatgtgatggccagctgcttcccttcttggttatccactgcagctgctagttagaaaggtttgcagggatgacttttagtaaatcatggggattttattgatttattatcacttataggattttgtggggtgggagtggggagcaggaattgcactcagacatgacatttcaattcatctctgcaaatgaaaagggttcttcctcttgggggaaatctgtgtgtcagttctgtcagctgcaagttcttgtgtaatgaagtsaatgctgtcaggccaagtgaa

SEQ ID NO: 127 - DNA, 1196 bp, Homo sapiens
  misc_feature (1)...(1196): n = A,T,C or G, or insertion/deletion polymorphism (see Tables 1-2)
cggggctctggatgagggatgggcgagggccgggggaagggaaaagggaggaggaggaggttgcggctggtttgaaagcggcagtttcctggcagcttgggcaggcgttggtctccgcgctacagctccgcagcggccacgatcgatcccgcgacgggtctacgcgcgcttctgcgcgccccccacggatttttcccgttcccggctcttcccccttcacctcaccgcccccccgcctcagcctttcccgccgctcgggcgctgagcccagggaccagccggcggcagtgaccccgcccgaagccccttctggaacctcctggggacaattcccttttcctttcttcagcctaacccacggtggccctcgcggagtccggtcagcggcgggttagtncatccgggaagggcgtccaggggcgtctcgcgtctgggaaacggccgggcccccacgggctgtggtcgcggggtgggggccggtacggcgaggccccccttaccgggctgcgcgggccgcccagggcccccgggctgagacggggccggcacggcgccccggctgcccgcgcggggtctccccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggggagtttgtgagaggcaagcctgtatctcgttgttctgattgggaattacacatgactatgaaaaatgggattttactatacataatggcatttaacagaagtagttttatgaaaggaaaatatcctacaagtaaaaggaaaaagcacaattctgaattgtttgcgtgggtgttaaatgcagtaaaacactgggcargtacttacaataaaggcttcactgcttggttctgtttcaaaacagagtttgtggccgtgcagtttaatctgtacagctaa

SEQ ID NO: 128 - DNA, 968 bp, Homo sapiens
cgacagcaccttctctggattcatcctcctgggcttctccaacaggcctcagctggaaacagctctctttgtggtcatcttgatcatctactttctgagctttctgggcaatggcaccattatacttttatccattgtagatcctcgcctccatacccctatgtatttcttcctctccaatctctcttttatggatctttgtttgaccacttgtactgtccctcagacactggtcaactttaaggggaaggycaagaccatcacctatggtggctgcgtgacccagctattcattgccttgggactcggggggagtggagtgsgtcttattgtctgccatggcctatgaccgctatgcagccgtctgccgcccactccactacatggtgagcatgcatccccaactttgcttgcagttggttgtaaccacttggctcacagggtttggcaattctgtgatacagacagcattgaccatgactctccccctctgtgataaaaaccaagtggatcatttcttctgtgaagttccagtgatgctgaaactgtcctgcaccaacacctccatcaacgaggctgaaatctttgctgtcagtgtcttcttcttggtggtgcctctctcactcatcttagcatcctatggtcacattactcatgcagtcctgaagataaagtcagctcaagggaggcagaaggcttttggaacctgtggttctcacctcctggtagtgatcattttctttgggacactcatctccatgtacctccagcctccctccagttattcacaggatgtgaacaaaagcattgcactcttctatactctggtgactcctctactgaatcccctaatttacactctgaggaacaaggaagtcaaaggggcaactaagaagactagtggggaggaccatagatgcatgagaaagttaacgcagggtttgcagttccaaacatttgtgcactag

SEQ ID NO: 129 - DNA, 475 bp, Homo sapiens
agagcccaagaacactggtggccaaaggatggtgtcttgtgaaaggagggcaagcaaaagtgtaggacaaattttgctttgggattttggttacacctgcagactatcccacagaaggaggaacagcactgaaatcctttctcgcaatcttcctgcattgtacacaggaatcaaggtctgtgagaagcgacccagcatagatctatgcatccaccactgttcatatttccaaaagtgtgaaacaaataagatatgctgttcagccttctgtgggaacatttgtatgagcatcctatgagtgggagagtgggctgggatgtgcatcctgctccctgaacccttccatccgagactgtgcccacatcygaagcacaaggacatcaaatcatcagcacaagaacatcaacaggaatgccaccctccccagtgtctgaactccctgtccctgtcaaataaaccagaacaaatgcccatg

SEQ ID NO: 130 - DNA, 630 bp, Homo sapiens
  misc_feature (1)...(630): n = A,T,C or G, or insertion/deletion polymorphism (see Tables 1-2)
agagcccaagaacactggtggccaaaggatggtgtcttgtgaaaggagggcaagcaaaagtgtaggacaaattttgctttgggattttggttacacctgcagactatcccacagaaggaggaacagcactgaaatcctttctcgcaatcttcctgcattgtacacaggcagctctgcagggaagtctgtgactgcctggccagacttagggctcacgctctggtcagagttatggcaccccagactctgctgcntgtcctggttctctgtgtgctgctgctgcaggcccagggaggataccgtgacaagatgaggatgcagagaatcaaggtctgtgagaagcgacccagcatagatctatgcatccaccactgttcatatttccaaaagtgtgaaacaaataagatatgctgttcagccttctgtgggaacatttgtatgagcatcctatgagtgggagagtgggctgggatgtgcatcctgctccctgaacccttccatccgagactgtgcccacatcygaagcacaaggacatcaaatcatcagcacaagaacatcaacaggaatgccaccctccccagtgtctgaactccctgtccctgtcaaataaaccagaacaaatgcccatg

SEQ ID NO: 131 - DNA, 751 bp, Homo sapiens
  misc_feature (1)...(751): n = A,T,C or G, or insertion/deletion polymorphism (see Tables 1-2)
cnttccctctctgggtgcacgctggnggtccccgacttctgcactatgcgtgaaatgcccctgggacacatcatgaggcaggaattggagaaaatttccctagagtacatcatgcgctgtctgcgggaagtcagcttctgctacccgcaaaacttcctgggcaaggaggtggtggncaactgcatccaggagcacattaaacagctgcattgcaagggggccctgcgngacagccagctggctgggatgtgtgcagtgtctctaaagggtgaactgtggggtgatcagttcaccccacagttctgggagcaacaagaagggccgcgaggccattggcttcctcctgtccctcactgacaggctagtcctctagtgcaggagccactgggaaaatactatgtcaaggagaggtccaaggcaatggtggcttgctatcttaaaaatggaataggttacattcatcatgtggacacctcaacaacgatggctgctgcaccacctgcatctactatctgaacaagaaytgggataccaggctacacggtgggatcctatggctattttcagaggagaaatcattcgtggcagatgtggaggccaattgtgaaaaagtcctgctctcctggtcagatcgcaggaagctacasgargtgctgtcttcctatgagaccagatgtgctatactgtttggtactttgataatgaagaaaggacagaagccaaaaagaaattcaggaatttaattaggaaa

SEQ ID NO: 132 - DNA, 2280 bp, Homo sapiens
gctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtccgtgacgagaagttattaccgaggcgcggccggggctctcctcgtctatgatatcaccagatgcccgaatgctagcgagccagaacattgtgatcatcctttgtggaaacaagaaggacctggatgcagatcgtgaagttaccttcttagaagcctccagatttgctcaagaaaatggcaactgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacawtcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattgtcaattgtraggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacmccatatatccttctgcatcctttggccaataaaagttgctggagaacca

SEQ ID NO: 133 - DNA, 6298 bp, Homo sapiens
gcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttkgtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatggcaaagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgggtgttcatacagtggcatttgggacacawtcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattgtcaattgtraggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacmccatatatccttctgcatcctttggccaataaaagttgctggagaaccaaaccatggtggttcttaatcaggctttgcctttagggagaatgaggaggagagataattgggtattgttcaggctagtaataaatgtcatgtttctatttcccgcaactcattargttttcaggaagctcttaatttagatttctaggaaagtaattattcagtcttcctagaaaaagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacctaaatgatttrtaatttgtactgtgacacagcagatgatgtttccttattttctgacatctttttatgtttttggagaggcacattagaggtgctttaaaaaaaacctgtgaatttttaatattttgtggtgccatttgtgaagcacctctttcctgatccatctaactactcctgtacgtacagtctgagtttgtcccacttgttgacttggttacttccctattgtatttatttctttaaagggttgttttagaattttagaggaatttatctgagaacacaagatctaccactttcagtaggacaagtgacccaagttgttggtcaccagcctcaaagtttagaaaacactacctactacctactgatagaaaataatgtggttagggaatctgtttttttcttttaaaagagcatttatgtacttttttccttcatatatccccctcattttttttctttttctttcttttttttttaattttattttttgtagagacagggagggtctcactgtgttacccaggctggtctcaaactcctggcctcaagggatcttcccacctcagcctcccaaagtgctgggattacaggcatgagccaccatgcctggccccccccaggtataatataatataaatataaatttatattatgaattatatagattctccctttatatacttataaattttttataacagattttcaaatgtagagaaaaatagcctaatgaaccactatatcagccagctttaacaattgcctacattttgcgatcttgttttctttatctttacccagcgttttcatactatggtacttgaaaacatccgaggcatctgtcatttcacccaaaaatactcagggccgggcgcggtggctcacgcctctaatcccagcactttgggaggctgaggtgggtggatcacgaggtcaggagttcgagaccagcctggccaacatggtataaccccgtctctactaaaaacacaaaaattagccaggcgtggtggtgggcgcctgtagtcccagctacttgggaggctgaggtgggagaattgcttgaacccaggaggcagaggttgtagtgagccaagatcatgccactgttctccagcctgggcaacagagaaagactccatctaaaaaaaaataaaaataaaaaataaaaaaaaaaaattggtcagtatgcatctttgacaatagcattttctaaaaattttatgaaatttccataccattgggaacttaacaaagccaaggctatttatgtttttcatatcttgcaatcatataaagttggttttctgatatgtgctaaaacagcaaaatgtgtctttcgtgaagcattggagacagtgacttcccagcatgtgtccagttgtacagaagtgctattccctggcccaggggcagttgtacctttagcagggayaccaggaccatcagcctgctatacatagccagcatgsstttggagggctggtaccccttgttgtactggttttaaaacactcctgccaatgtagtaacatgaggcatatttactttaaatcatctctacaaatttgaagatatcatcttcaaactactctatttgaagaatgtattttactgtaaaggcaacatttaactttgatgcatgcttgtccggaccatatgtaactgtatacaaggggggttgagccattcctttttttgtttgttgttgttgttgtttgtttgttttaattttcagagacacagtcttgctgtcacccaggctggagtgcagtggcacaatcatagctcaccacagcctcaacctcctaggctcaagcaattctgcctcagcctcctgagtagctgggactacaggcatgcaccactgcacctggctaatttttttttatgtcttgcctctgtgtttcctaggctggtctcaaacttctggcctaaagcattcctcccaccttggcctcccaaagccttgggattataggcgtgagccaccacacctggccctccatttcttaaacttgcaataatctggtgtgctccttcatgctgaagggcactgtcgtgaaacttctgtggaaaactccatggaaattggataagcctgtgctctcaaaactctcttaacttcttgatgcaatgtgtaaacttcattttaaagaaaactagagtgaagaaaacaaacttgcttaatttctgagtattttacattctaagatgtcatgaaaataattatgtttactaaatattgaaggaccaagtaatgatgcatgatggtaaaaatgctaatttctgtatgtttggatgtgagccctcaaataattttaaattgaataggaaattttataatatgattgattttaggtaaatctaccacattgttagcttttacagaaaagtcatcatattggtttgcgtggccataaaggtacctaccatgcccttatactattctcacttccagcagaaaatgctgcttttataggacactcgtgaacctctctgaacgcctctggctttctcacagtctctgtggggactcaagttcctcacctggaatgctcctcagccagccctctaagtcagtcgagcggaaggcctgctgctctttggggtgcagtgtgcaaaacttctctgctgcggcgctttctctgacctcagcatatgcagacacccaactcccatgattctctgtctggacctcctttcttgctattgatctcattgattgtaccttgtccttgtttgtcttctctcctgggctaagagctccctgggacagggctgctttggtgtgcctgatgcctgacacataggagggaccccagggcttgtgggaaaaaatgatcacagagccaactgtgtccctaagtctttcaagggtatctgcatatcactggtgcagcctttccactgcaagatcccactttgcaaaatttccaaacaggcagttaaaacccttccttcctgcagtaggtcgctttgtttttgaatattgatgaccttccgggattgatagctcacaatatgtaggtctcatgttttgttgtcaggtaaacaacaacatgttggggattctgtctgtgcactcctacttgactcctggcacatctcacagcacagcctgtgaacaagcagttatgcctgctgtgttctccatcttagcagaattcgatattgtaggaatagggagctttacctcgagggttgtcagatgcaattgaggatataattgtcaataaacctctgatctaaagcct

SEQ ID NO: 134 - DNA, 769 bp, Homo sapiens
gcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttkgtggtaaatatgtaaagttacaaatatgggatacagcaggacaagaacgattcagaaacttcatttttggaaactttgattgacaagacagctaaaatttaggttagctctctgcagcatggattactaaagaatacaggaggatctccgcgcaactgcattataattcggaggctgacccattctcaggaggatgtggcactgtgtattgtacagtatgtttctagattcaaatcaaagcacaagcttgtttttctgtgttccttttttaaagaagaactttttaaaaccttgtgagggtttgttttgttttacattaacta

SEQ ID NO: 135 - DNA, 5986 bp, Homo sapiens
cggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgggtgttcatacagtggcatttgggacacawtcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattgtcaattgtraggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacmccatatatccttctgcatcctttggccaataaaagttgctggagaaccaaaccatggtggttcttaatcaggctttgcctttagggagaatgaggaggagagataattgggtattgttcaggctagtaataaatgtcatgtttctatttcccgcaactcattargttttcaggaagctcttaatttagatttctaggaaagtaattattcagtcttcctagaaaaagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacctaaatgatttrtaatttgtactgtgacacagcagatgatgtttccttattttctgacatctttttatgtttttggagaggcacattagaggtgctttaaaaaaaacctgtgaatttttaatattttgtggtgccatttgtgaagcacctctttcctgatccatctaactactcctgtacgtacagtctgagtttgtcccacttgttgacttggttacttccctattgtatttatttctttaaagggttgttttagaattttagaggaatttatctgagaacacaagatctaccactttcagtaggacaagtgacccaagttgttggtcaccagcctcaaagtttagaaaacactacctactacctactgatagaaaataatgtggttagggaatctgtttttttcttttaaaagagcatttatgtacttttttccttcatatatccccctcattttttttctttttctttcttttttttttaattttattttttgtagagacagggagggtctcactgtgttacccaggctggtctcaaactcctggcctcaagggatcttcccacctcagcctcccaaagtgctgggattacaggcatgagccaccatgcctggccccccccaggtataatataatataaatataaatttatattatgaattatatagattctccctttatatacttataaattttttataacagattttcaaatgtagagaaaaatagcctaatgaaccactatatcagccagctttaacaattgcctacattttgcgatcttgttttctttatctttacccagcgttttcatactatggtacttgaaaacatccgaggcatctgtcatttcacccaaaaatactcagggccgggcgcggtggctcacgcctctaatcccagcactttgggaggctgaggtgggtggatcacgaggtcaggagttcgagaccagcctggccaacatggtataaccccgtctctactaaaaacacaaaaattagccaggcgtggtggtgggcgcctgtagtcccagctacttgggaggctgaggtgggagaattgcttgaacccaggaggcagaggttgtagtgagccaagatcatgccactgttctccagcctgggcaacagagaaagactccatctaaaaaaaaataaaaataaaaaataaaaaaaaaaaattggtcagtatgcatctttgacaatagcattttctaaaaattttatgaaatttccataccattgggaacttaacaaagccaaggctatttatgtttttcatatcttgcaatcatataaagttggttttctgatatgtgctaaaacagcaaaatgtgtctttcgtgaagcattggagacagtgacttcccagcatgtgtccagttgtacagaagtgctattccctggcccaggggcagttgtacctttagcagggayaccaggaccatcagcctgctatacatagccagcatgsstttggagggctggtaccccttgttgtactggttttaaaacactcctgccaatgtagtaacatgaggcatatttactttaaatcatctctacaaatttgaagatatcatcttcaaactactctatttgaagaatgtattttactgtaaaggcaacatttaactttgatgcatgcttgtccggaccatatgtaactgtatacaaggggggttgagccattcctttttttgtttgttgttgttgttgtttgtttgttttaattttcagagacacagtcttgctgtcacccaggctggagtgcagtggcacaatcatagctcaccacagcctcaacctcctaggctcaagcaattctgcctcagcctcctgagtagctgggactacaggcatgcaccactgcacctggctaatttttttttatgtcttgcctctgtgtttcctaggctggtctcaaacttctggcctaaagcattcctcccaccttggcctcccaaagccttgggattataggcgtgagccaccacacctggccctccatttcttaaacttgcaataatctggtgtgctccttcatgctgaagggcactgtcgtgaaacttctgtggaaaactccatggaaattggataagcctgtgctctcaaaactctcttaacttcttgatgcaatgtgtaaacttcattttaaagaaaactagagtgaagaaaacaaacttgcttaatttctgagtattttacattctaagatgtcatgaaaataattatgtttactaaatattgaaggaccaagtaatgatgcatgatggtaaaaatgctaatttctgtatgtttggatgtgagccctcaaataattttaaattgaataggaaattttataatatgattgattttaggtaaatctaccacattgttagcttttacagaaaagtcatcatattggtttgcgtggccataaaggtacctaccatgcccttatactattctcacttccagcagaaaatgctgcttttataggacactcgtgaacctctctgaacgcctctggctttctcacagtctctgtggggactcaagttcctcacctggaatgctcctcagccagccctctaagtcagtcgagcggaaggcctgctgctctttggggtgcagtgtgcaaaacttctctgctgcggcgctttctctgacctcagcatatgcagacacccaactcccatgattctctgtctggacctcctttcttgctattgatctcattgattgtaccttgtccttgtttgtcttctctcctgggctaagagctccctgggacagggctgctttggtgtgcctgatgcctgacacataggagggaccccagggcttgtgggaaaaaatgatcacagagccaactgtgtccctaagtctttcaagggtatctgcatatcactggtgcagcctttccactgcaagatcccactttgcaaaatttccaaacaggcagttaaaacccttccttcctgcagtaggtcgctttgtttttgaatattgatgaccttccgggattgatagctcacaatatgtaggtctcatgttttgttgtcaggtaaacaacaacatgttggggattctgtctgtgcactcctacttgactcctggcacatctcacagcacagcctgtgaacaagcagttatgcctgctgtgttctccatcttagcagaattcgatattgtaggaatagggagctttacctcgagggttgtcagatgcaattgaggatataattgtcaataaacctctgatctaaagcct

SEQ ID NO: 136 - DNA, 2640 bp, Homo sapiens
gcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttkgtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacawtcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattgtcaattgtraggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacmccatatatccttctgcatcctttggccaataaaagttgctggagaacca

SEQ ID NO: 137 - DNA, 2156 bp, Homo sapiens
gcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttkgtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacawtcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcc

SEQ ID NO: 138 - DNA, 1842 bp, Homo sapiens
atgtccaaaaagaactgggtcaccacaggcacctggagacaaagtggaaatgaaagaaaatcagtaaggaagagctctgtggctgaactgggtgctcatcacgggaactgctgggstatggaatacagatgtggcagctcaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccytgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgact

SEQ ID NO: 139 - DNA, 2888 bp, Homo sapiens
gcagctttcagaatgacagtctgcagaagtgagctgagcgtgtgcgcggtacggggctctcctgccttctgggctccaacgcagctctgtggctgaactgggtgctcatcacgggaactgctgggstatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccytgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaa

SEQ ID NO: 140 - DNA, 1542 bp, Homo sapiens
atgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccytgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatga

SEQ ID NO: 141 - DNA, 2246 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatcygaccaagccaaccacccggcaaagatacgacggcagcaccactgccatggaaattctscagggccgggatttcactggcaaagtggttgtggtcactggagctaattcaggaatagggttcgaaaccgccaagtcttttgccctccatggtgcacatgtgaycttggcctgcaggaacatggcaagggcgagtgaagcagtgtcacgcattttagaagaatggcataaagccaaggtagaarcaatgaccctggacctcgctctgctccgtagcgtgcagcattttgctgaagcattcaaggccaagaatgtgcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtggagatttacagatattaacgactccttgggaaaastggacttcagtygcctctctscaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggycccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgctttctggtgstggcctgtttgaaagtaaaaacctgsttggygtgtaggttccgtatctccctggagaagcaccagcaattctctttcttttactgttatagaatagcctgaggtcccctcgtcccatccagctaccaccacgrccaccactgcagccrggggctggccttctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctaygcttaataaaagaacatgcttgaatatc

SEQ ID NO: 142 - DNA, 7138 bp, Homo sapiens
tctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttggracttacgtggaagtagatatgtttggtttgcctgtggatacaagraggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcragaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaaytaaagaagaaaatggataaaaagaggcaggagaagataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgagttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 143 - DNA, 6456 bp, Homo sapiens
gaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttggracttacgtggaagtagatatgtttggtttgcctgtggatacaagraggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcragaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaaytaaagaagaaaatggataaaaagaggcaggagaagataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 144 - DNA, 7192 bp, Homo sapiens
tctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttggracttacgtggaagtagatatgtttggtttgcctgtggatacaagraggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcragaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaaytaaagaagaaaatggataaaaagaggcaggagaagataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 145 - DNA, 7020 bp, Homo sapiens
tctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttggracttacgtggaagtagatatgtttggtttgcctgtggatacaagraggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcragaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaaytaaagaagaaaatggataaaaagaggcaggagaagataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgagttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 146 - DNA, 579 bp, Homo sapiens
atggccggggctcaacccggagtgcacgccttgcaactcaagcccgtgtgcgtgtccgacagcctcaagaagggcaccaaattcgtcaagtgggatgataaatcatggaccatggaagaacaagaatatggtagacatgaaggaaatgtagagggtgagttgcctgctctcaagcacgatgcagaatgcaagacagtgtcaactgagaggccagatctatattacttgtgcagggaggactcaactattgttactccaattattttgaggactgaccctcagggatttttcttttactggacagatcaaaacaagctcttctgccagcctctcctggagactgaggggcttccaggccagtgggccctaggctttgagaaatccctcagacatagatgcagctggaagctgtccgttggcatacatgaaaacacatgggcaccaccagcagcaaccactctggtggctttaatttctgaagatattggagtagctcagatgccactttgggagctcaaaggggaagctagccctgcagaagacaagccagtgaagaaccaagtccttaatgatgtcatt

SEQ ID NO: 147 - DNA, 7074 bp, Homo sapiens
tctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttggracttacgtggaagtagatatgtttggtttgcctgtggatacaagraggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcragaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaaytaaagaagaaaatggataaaaagaggcaggagaagataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 148 - DNA, 4352 bp, Homo sapiens
  misc_feature (1)...(4352): n = A,T,C or G, or insertion/deletion polymorphism (see Tables 1-2)
tcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagccngtgaacctgtactgtaaagcaagccctgccacccagatctatttcaagtgtaatagygaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacatygttgccaagaggaaaagtacaactgccactgtcatagtctatgtcaacggtggctggtccacctggacrgagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcrctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccmgtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgynaagcgcctcaagctggccatctttgggcccctgtgctgctcctcgctggagtacagcatccgagtctactgtctggatgacacccaggatgccctgaaggaaattttacatcttgagagacagaygggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtrctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccrtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcwgataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaacca

SEQ ID NO: 149 - DNA, 3898 bp, Homo sapiens
  misc_feature (1)...(3898): n = A,T,C or G, or insertion/deletion polymorphism (see Tables 1-2)
tcttctttctcagatgatgacttttttcatgaactcccagaaacttttccttctgatccacctgagcctctgccacatttccttattgagcctgaagaagcttatattgtgaagaataagccngtgaacctgtactgtaaagcaagccctgccacccagatctatttcaagtgtaatagygaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacatygttgccaagaggaaaagtacaactgccactgtcatagtctatgtcaacggtggctggtccacctggacrgagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcrctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgcccmgtcgtcctcactatgcatcactgcgcagaccccaataccgaggactggaaaatactgctcaagaaccaggcagcacagggacagtgggaggatgtggtggtggtcggggaggaaaacttcaccaccccctgctacattcagctggatgcagaggcctgccacatcctcacagagaacctcagcacctacgccctggtaggacattccaccaccaaagcggctgynaagcgcctcaagctggccatctttgggcccctgtgctgctcctcgctggagtacagcatccgagtctactgtctggatgacacccaggatgccctgaaggaaattttacatcttgagagacagaygggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtrctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccrtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcwgataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaacca

SEQ ID NO: 150 - DNA, 2017 bp, Homo sapiens
  misc_feature (1)...(2017): n = A,T,C or G, or insertion/deletion polymorphism (see Tables 1-2)
aagggccctggatccccttgccccgtcgcgccgtcgtccccccgctatccggttttgtgatggccgcgccgtggctgcctccctagagtccctcagsgccctttaaataccgcgttgggggggacrctggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttyccggttttccgaaagcatggcttcgctcagtgactatgaatgctccaggcagagctttncaagtgactcctccagcaaatccagctctcctgcttcaacaagccctccaagggttgtaacatttgatgaagtgatggctacagcaaggaacttatcaaacttgactcttgctcatgagattkctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagaggcaagttgctttgttgtctgtattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacayatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgt

SEQ ID NO: 151 - DNA, 2243 bp, Homo sapiens
  misc_feature (1)...(2243): n = A,T,C or G, or insertion/deletion polymorphism (see Tables 1-2)
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttyccggttttccgaaagcatggcttcgctcagtgactatgaatgctccaggcagagctttncaagtgactcctccagcaaatccagctctcctgcttcaacaagccctccaagggttgtaacatttgatgaagtgatggctacagcaaggaacttatcaaacttgactcttgctcatgagattkctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaaggtagatgcttcacctcctactaactaaagaagaactgacattggacgagagattggaaatccagtactttggtatccagtccacttccattgatggcattagagatccagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacayatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgtatttgaaaaaaaaaaaaaaaaaaaaaaaaaaa

SEQ ID NO: 152 - DNA, 616 bp, Homo sapiens
cgccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactaggaaggaagactcaaaatttaaaaatagaaaaaaaaatgatggcccagaagagcaagttcagagtgctgttcatgagtgatccgcatgggaccgcgatgcctctgacgtctgccatcctggagagcagcagagcgtcactagcagccaaacaggaagacaagtgtttcacrgacrtaagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaayctcagctctcagcctygaaaacaaggatggctgtactactcacttttttcttcttcttcc

SEQ ID NO: 153 - DNA, 739 bp, Homo sapiens
cactgcgaggaaagcaaagtctgggccatggagatgagcctagtcctgctgttcctgatccgcactgccctttttgcaccccagggagctgctgctggaggtgtgtgatgaagtatttagtggtctagtatcatgggtcttgcaacttactttagaatgactcagtcaaaaatcttaatctggacccttttcataagatggtgccaagaacgaagaaggaagctcctgcccctcctaaagccgaagccaaagcraaggctttgcaaggccaagaaggcagtgttgaaagatgtccacagccacaaaaaaaacaagatccacatgtcacccaccttcyggcggcccaagacactgtgactccggaggcagcccaaatatccttggaagagcacccccaggagaaataagcttgaccaccatgttatcatcaagwttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctaattccaaatatatgtatatcttttcaccattaaaagaatcttaatctctctat

SEQ ID NO: 154 - DNA, 6339 bp, Homo sapiens
  misc_feature (1)...(6339): n = A,T,C or G, or insertion/deletion polymorphism (see Tables 1-2)
agacgtcgccgggtgaggaagcggggggctagcggcctggcgctgcggcgaccgaccggggcgtcaggatccctggcccccggagagcgaagggcgggcgggtcccggagcaagaagaattgtatagaaatgtaaamaacatttatgtgtgcttcacatgtggcatgaaaaaaatgaggacctctggtcaaaattgcctgagttcagaatttcatgctggaaggaaagttagacgtaacttctaatttctagttccagtaagcatctcttcttggaaaatttccaaaaaagagtcctgctctgttgcccaggctggagtacattggtgtgatgatcatggttcactgcagcctcgacctcccaggctcaagcaattctcctacctcagcctcctgagtaactgggactataggatttctttgaagaaaaatgtgcttcttgaatcaactgcagtctctcctctgcataagagctcttaagggtactagcaggatagaagcaaatgaaactgaaagctcatctgcagctcagaaaagcaaagacatggaattttaaagagtgaaggtagcatggtgtcggccatgggtgaacaagacacagccagacaatgtggaccaatttcttcaaactacggcttttctgctgtctgcttgcagtgttgatggtggtggtgctggtcatcaatgttactcaggtagagtacttggaccatgagactgtttcagccactttcatcgacagcagtggacagtttgtttcctcccaggtgacaggaattagccgaaatccctactgtggctatgatcagcagaccctgtccagccaggagcgcatggaggaggactccttgctggctgccttgcaccggcaggttcctgatgtgggcccagtcccctttgtgaagagcactgacccttcttccagctactttgtcatcttgaactctgctgccttctttaaggtgggaagccagcttgaggtgctggttcatgtgcaggattttcaaagaaagcccaagaagtatggtggagactacctgcaggccagaattcactccctcaagctgcaggctggggctgtgggcagggtggtggattaccagaatgggttttacaaggttttctttactttgctatggccaggcaaagttaaagtatcygtatctctggtccaccccagtgaagggatcagagttcttcagcgcttacaggaagataaaccagacagggtctatttcaagagtctcttccgttcaggaagaatttctgaaactactgagtgcaacgtgtgtcttcctgggaatctgcccctgtgtaactttacagacctctacactggggagccctggttctgcttcaaaccaaagaagctcccttgcagcagcagaattacccatttcaaaggtggatacctgaaaggtctcctaaccgctgcagagagtgctttcttccagagtggtgtcaatatcaaaatgccagtcaactccagtggacctgattgggtaactgtgattcccaggagaataaaagaaactaacagtctagaactatctcaaggstcaggaacttttccttctgggtattattataaagaccagtggaggcccagaaagtttaagatgcgtcagtttaatgaccctgacaacattacagagtgcttacaaagaaaagtggtgcatttatttggtgactcaacaatcaggcaatggtttgaataccttactacatttgttccagatttagtggagtttaacttgggtagtcccaagaatgtgggtcccttccttgcagtggaccagaagcacaacatcctgctcaaataccgctgccatggtccacccatccgcttcacgactgtctttagcaatgagctccaktatgtggcgaatgagctgaatggcattgtgggagggaagaacacagtggttgccatagctgtatggtctcacttcagcaccttccctttggaagtgtacatccggcggctcaggaacatccgtcgagcagtggttcggctcctcgatcgaagcccaaagaccgtggtggtcatccggacrgccaacgcccaagagctgggacctgaggtgagccttttcaacagcgactggtacaactttcagctggacaccatccttcggaggatgttctcaggggttggagtatatctcgtcgatgcctgggagatgaccctggcccattatctaccgcacaagctgcatccagatgaagttattgtgaagaaccagctggacatgttcttgtcctttgtgtgccccttggaaacctagcctgtcttggaagggactggaggaatcatattcaatgaccttctcaattgacctgagttacagaaagtggccccagtgagagatgactgcccttaataagtataaaatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgrtattataaagctgtggaagttttttccactagtttcaggtgtttttttttttkttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttgggatcatttagtaagtactcttttctttttgagctgtgatagattatagtctagtttaagttgctcctaagtagacagatgaagaaactagggaggctttagagaggaagacagatgcttgaagtatgaacaatatatacccttagaagaatgggtcaaataatttgggtttttaatttaaaataggagggccccagatcttactttcctgtccttgaggaacaccttcaagtttttaaagtattttagggggaaagaagatttttaattgtttctgagcctaatgaggtaataaaatatattaaaatagtttaattttaatggtccttacgctttacagtacctaaggatcacttgtagtatctgacaaaaatgcagaattaaagagtcatggcagggtgtggtagctcaagcctgtaatcccagcactttgggaggccaggcaggaggattgcttgaggccaggagtttgagaccagcctgggcaacatagtaagacctcatctctacaaaaaataaaaaattatccaggtgtgggccgacagtcccagctactagggaggctaaggcagggtgattgattgagcccagtagtttgaggctgcagtgagttatgattgcgccactacactcccacttgggcaacagacaagagatcttatctctaaaaaatttttgttaaataataaaagaattaaggccagggatgttggctcacatctgtaatcccagcagggattatagtctcgggaggctgaggtgggcggattgcttgagcccggaaggtcaagaccagcctgggtgccatggtgaaaccccatctctacaaaaaaatacaaaaactagctgggtgtggtggcaccacctgtagtccccgctacttaggaggctgaggtgggaggattgcttgagcccaggaggcagaaggttgcagaggttgcagtgagccttgattgtgccactgtactccagtctgggcaacagggcaagaccctgtctctaaaaaaaaaaaaaaaaaaaaaagagggaccatgatgcctctgggatttatgaaaccaacctttgtggcgagtgctcagtgattctgatgcaatggtggtattccacactgtgagaaacactaagagaagaggtaagatagaatgagggaataaacatggcttgtttattattttgggggatttaccaataactggtttaattctgttcatgatccaatagtattggtgatattagctccattttatagatgaggaactcatgtttagatctgaaataaggtatgtgagagtccatatctcttttcagctaaacttgtgagactttcgtaaagaagcgtttgtatttatttatttgtttttgagacagggtcttgctcttttgcccaggctggagtgcagtggcatgatatggctcactgcagccttgacttcctgggctcaagggatccttctgcctcagcctcctgagtagctgggactacaggtatgtaccaccatgcccagctaatttttgtatctttttgtagagactacattttgccatgttgtccaggctggtcttaaactcctgagcycaagcatctgcccacctcagcttcccaaagtgctgggattacaggtgtgagccactgtgcccagctgagagtttttcttgtcntgaaagaacttgacatttcctcaaggatttataaaggaggctgaggagtaattttcccaggagaattttaaaaagaaagcgggcattgctcctccagtggtttggaatgatgccacttgattgtgcaaatgatttcttatgatcttgtctggttttctgttattttttgatttggtgacatagctctcaaagatttggtgacacagcttcttgagtcactttcatctctcttaaaaaaawtttttttttaacaacttttaagttcaggggtacatgtgccagtttgtttcataggtaaacttacgtcatgggggtttgttgtatagatgatttcatcacccaggtgttaagcctagtacccattagtaatttttcctgatcctctccctcctcctaccctccaccctccaatagaccccagtgtgtgttgttgccctttatgtgtccatgtgttctcatcatttagctctcacttatcagtgagaacaactttcatcccacatctaatttgtctttcttcactctggtgtggaaattttgatagagattccaatatcacttaaacgtttcccagaatatttagatagaataatttagtttcttctgaaaagtttattttaggctagtgccacatggttgtgaatattagcatggtagccaaataatagtttgtttaaatgtatatttcccaatataaatataaggggcatcataatttttaaaaactataaaatctagaagaaaaatctatggataaaatccataattctatcatctgaatgcaatgaacattagcatttaggtatattttcttgcaggttttttaaccatatacttatagagaatatgtaatttgggtctgtgttttttacatataaatatttttctatgttaaatagtcttcataagttaattataaagatctgcttaatagttctgctactgcagttttcattattagataagttggtcattatagttggacatttaggtttacaatattaaagcagtggtttatatcaatttcagtggtttaaaatatgaatttctattttggaatgaaagtattaatttaatgtagtgaatctcatattccagaactgagatgattgatttgatgctatttgtgacagacagaacccataataaagcctttctatgcaagttacattttatagaattatcctactaaaagtaacctttcttcagcgaatgcaaaacagacctttggtgttccagtatgattc

SEQ ID NO: 155 - DNA, 819 bp, Homo sapiens
actcgcgcgcccgcagctcgcgcaggctgcccgggccgtagccgtaggctagccgcggtgcgctcgggtcccgggaacccgcgaaggtccacagctcccgccctgactccgcygccgcgccggccatggccccggctagtccatccaggcyggccgggcccgggaagtgmgcgaagccggcccccggcgactccgcccccrccacgcctcccaggcctccagcctcccagtctctcggaatccgcagcctaggtgtggcgccccgaccggactttcacttctggccagccctttccccacctgggcgcgggagcgggtgccagtctttaaacaacctctcgatgggtcccacgaagatgtttccagacccttggaatgccaagttcaagtttagctatgtctcgcggagaggccggtggaagaagcaacgagaatgaagcaccccagttctctgctgagcacatgggcatctgcaataaagatttaatttcccagcttctcctgaagctcggtatggccacaacactaaattctgcccgaggagattaagcaaaatagtatgggacttccaagaaatgttkttaaagtcagrggcaggcctttcttcatgccttcttcctctttkctggctggaaygcaaagaccatggcaggaggccaagcagccatcctggaaggtgaaagcctcatactaaggacgtcagacagcgaaataagagcctgggtccttgaccctgtagacatctccctccccatcctggtctgtctgccttgactcctttcatatgagagaaataaacttttaacttgcgtaaaccag

SEQ ID NO: 156 - DNA, 506 bp, Homo sapiens
agaggggtcatagttctccctgagtgagactcacctgctcctctggcccctggtcctgtcctgttctccagcatggtgtgtctgargytccctggaggytcctrcatgrcagykctgacagtgacactgatggtgctgagctccccactggctttggctggggacacccaacgtaagtgcacattgtgggtgctgagctactatggggtggggaaaaaagggagttttgttaacattgtgcccaggccatgtcccttaagaaagtgtgacattttcttcagggattgcccatctttattgtatggatcccaaattatttccaccacaaatggaacgtggctacttgccctcttcatgagactgtgtaaggggcctttgtataggccattttttttctttaaatctccaccaataaaacctttgtatcacatgtcctcagggtctttagaggatttagaaataaggatgctaaaataaattcctcatacagcacttccctttatcat

SEQ ID NO: 157 - DNA, 1271 bp, Homo sapiens
ggtcagctgcacctagaaggggccccctcctggctcaaaaatggctgcaaccacatgagccatgtgactcaggatggagggtggcactgtccacaaatcggcttctctgcagagcccactctgcaaggctgcggtgaggggctgaggctggctgcctggtgggatggcctgagatcctgctcctgctagggccagaggccaactgcctctagggttgcttggtgcctcagtaacaggtggtttgagtggatgtctcctgcaggaaccatgactagaaatgtggttagacaagaatttgaggctccagggaagccacaggattctagccagcaggatgcctgcttaatcctcgtaaaaggaaactggacaacaaacgagatggaggtaaaatgaaatcccaaaggaacgcctccaaggatcccgtcttctacctgtcaggagatgttctatttttctaacttccccaccttcagcataacaggatttagtaactgtttagaccttttgaagaacaaagacaaaaataggaagttgtgtcagaggagtgcagtcatctcttattcatggtagtgttttggttcgattttggagcatccaccaggttcgcgtacaggagaagaaacasggatgatctctgtctttattttgggggaggacaatccggccttcttgggactgttccagcccacctcccagatgcttcggtcagtctgatccacgagatatctcaggctgggaagaacayatcttgggccaacttccacagcagccatgcgtccaaggatacagaatcaggcaggccgataaaaggattttgacttgggtttcacaggaaggaggtatgccatcaaaccccactgtagtcaaggatcagaaggtgcttttagcaggaactgaagctttttagtataaggcccacttagggtgccagcaccctgacagtgtccctttaatccacttcagatctggttgactcatcatcaggtgtttccattcactttcaaaattacacagtcacaggataacagtgagatccactgctaaagggtaaagggtcagaggctgaagagtactgtgtaatgtctgcatgagatttgttttaaaaaagtctgaattggcatggtattttgaatgctgctggaactgtaataaaggttcacctttaggaagtgctgatggcacaccagggcccagcacaccgcatgcactattctatagaatttgcccaacaccctttgtgctacagattactattatacccattttacaga

SEQ ID NO: 158 - DNA, 1211 bp, Homo sapiens
ggtcagctgcacctagaaggggccccctcctggctcaaaaatggctgcaaccacatgagccatgtgactcaggatggagggtggcactgtccacaaatcggcttctctgcagagcccactctgcaaggctgcggtgaggggctgaggctggctgcctggtgggatggcctgagatcctgctcctgctagggccagaggccaactgcctctagggttgcttggtgcctcagtaacaggtggtttgagtggatgtctcctgcaggaaccatgactagaaatgtggttagacaagaatttgaggctccagggaagccacaggattctagccagcaggatgcctgcttaatcctcgtaaaaggaaactggacaacaaacgagatggaggtaaaatgaaatcccaaaggaacgcctccaaggatcccgtcttctacctgtcaggagatgttctatttttctaacttccccaccttcagcataacaggatttagtaactgtttagaccttttgaagaacaaagacaaaaataggaagttgtgtcagaggagtgcagtcatctcttattcatggtagtgttttggttcgattttggagcatccaccaggttcgcgtacaggagaagaaacasggatgatctctgtctttattttgggggaggacaatccggccttcttgggactgttccagcccacctcccagatgcttcggtcagtctgatccacgagatatctcaggctgggaagaacayatcttgggccaacttccacagcagccatgcgtccaaggatacagaatcaggcaggccgataaaaggattttgacttgggtttcacaggaaggaggtatgccatcaaaccccactgtagtcaaggatcagaaggtgcttttagcaggaactgaagctttttagtataaggcccacttagggtgccagcaccctgacagtgtccctttaatccacttcagatctggttgactcatcatcaggtgtttccattcactttcaaaattacacagtcacaggataacagtgagatccactgctaaagggtaaagggtcagaggctgaagagtactgtgtaatgtctgcatgagatttgttttaaaaaagtctgaattggcatggtattttgaatgctgctggaactgtaataaaggttcacctttaaaaaaaaaaaaaaaaaaaaaaaaaaaaaaaaaaaaaaaaaaaaaac

SEQ ID NO: 159 - DNA, 659 bp, Homo sapiens
acaagtggggcatctgtaggggccacagtgagctctcaatgatcatctgtagtggcagcaaaagagttcgagccccacttcaaacaacttcataataaaaggccagacaaaagagctgtcagccagttactacagacactcaatgcagacaccttcagagtattgggaaaagacttgccttctgccagaacttaacccaaatacacacagasagcaccatgaagccctggattcttctactcgtcatgttcayctctggagttgtgatgcttctgcctgtgctgggaagcttctggamcaaagatccctttctagatatgataagagaaactgagcagtgctgggtacagcctccatataagtactgtgagaaaaggtgtactaaaataatgacttgtgtacgtccaaatcatacatgctgctggacctactgtggaaayatctgcttagacaacgaagagccccttaaatcaatgctaaacccctagattctattggccgatcactactgtgggctgaaggatgaccatctggtctaagaagagtgctgcctacttccttcttgggacacccactggctctagctggtaacctttctgctatttccttgacctctttaccctgaagcttttgtcaaataaactgctacatcaacctga

SEQ ID NO: 160 - DNA, 802 bp, Homo sapiens
agagcaggtacagcgtgggcagcgccagagagcccttccctaccctgccccgcccatgtgcctccaccctgacctggagagaccacctgtagggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaayaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtg

SEQ ID NO: 161 - DNA, 6171 bp, Homo sapiens
gggggcgtcctccgcagttcgctcctcgccggggctcagacacacagccagcccagagccgccacgccggcccggccgccgccgccaccgcctcagcctcccccgaagccgctctagccgcgggaagcgccgctgccacagccgcgggccgcccccgccgcgccggcctgggctcaagctgccagcaccgccgcagccgccaccggagccggagcgggagcccgaccgcgctgggctgggctgggctgggctggggcgggcgcagggcgcaggggcgggcgcgcgggggaagacgcacgggcgggctcggctctcccggggagcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtyatgttctacgacagcgagtatgatatccgtgggcttcaaagctttctggaccaggcctcgcggctgggccttgaygtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggcygtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactctyaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcrttgtggacttcagcaagcggtacatggactattcagtggggattctaattaagaagcccgaggagaaaatcagcatcttctccctctttgctccatttgatttcgctgtgtgggcytgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaayaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaacyctcccttccasctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgcyccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgtgagagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataata

SEQ ID NO: 162 - DNA, 3286 bp, Homo sapiens
gggggcgtcctccgcagttcgctcctcgccggggctcagacacacagccagcccagagccgccacgccggcccggccgccgccgccaccgcctcagcctcccccgaagccgctctagccgcgggaagcgccgctgccacagccgcgggccgcccccgccgcgccggcctgggctcaagctgccagcaccgccgcagccgccaccggagccggagcgggagcccgaccgcgctgggctgggctgggctgggctggggcgggcgcagggcgcaggggcgggcgcgcgggggaagacgcacgggcgggctcggctctcccggggagcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtyatgttctacgacagcgagtatgatatccgtgggcttcaaagctttctggaccaggcctcgcggctgggccttgaygtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggcygtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactctyaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcrttgtggacttcagcaagcggtacatggactattcagtggggattctaattaagaagcccgaggagaaaatcagcatcttctccctctttgctccatttgatttcgctgtgtgggcytgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggctcatgagtggaagggacttgccttgtctcagatgagactttggactgtgaacttttggattaatgctgaaatgagttaagactttggaggattgttgggaaggcatgattccttttgaaatgtgaggacatgacatttggaggggccaggaatggaataatatggtttggctctgcctccatccaaatctcagcttgaattgtatctcccagaattcccaggagggatccagggagaggtaattgaatcatgggggccggcctttcccatgctattcttgtgatagcgaatagtctcacgagatctgatgggtttatcagggctttctgcttttgcttctccctcattttctcttgcctacgccatgtaagaagagccttttgcctcccatcatgattctgaggcctccccagccatttggaactttaagtccaattaaaccttttttttttttgttcccagtttcaggtatgtctttatcagcagcatgaaaacaaactaatacagacacttaattcctccagcactatttgttgaaaagactgttcttcttccattgaatataccgtttgcatgtgcactacgaaatgattactaaaatgaagctaagtaacatatctgttacctcacacagttatcagttttttgcatgtgatgagaatatttaagatctgctgttttagccaatctcaaatgtataacacaattttattaactatagcaccatgctgtacattatatctccagatcttattcatcatacctaactgaaattctgtactctttgacaaaaagctcataattcccccacactccagtccctggcaaccaccattctctggcaaccaataaactctccgcttctatga

SEQ ID NO: 163 - DNA, 6003 bp, Homo sapiens
gggggcgtcctccgcagttcgctcctcgccggggctcagacacacagccagcccagagccgccacgccggcccggccgccgccgccaccgcctcagcctcccccgaagccgctctagccgcgggaagcgccgctgccacagccgcgggccgcccccgccgcgccggcctgggctcaagctgccagcaccgccgcagccgccaccggagccggagcgggagcccgaccgcgctgggctgggctgggctgggctggggcgggcgcagggcgcaggggcgggcgcgcgggggaagacgcacgggcgggctcggctctcccggggagcggcccgggactgcaccgggaccagcgcctccccgcttcgcgctgccctcggcctcgccccgggcccgggtggatgagccgcgcgcccgggggacatggaagcgctgacgctgtggcttctcccctggatatgccagtgcgtgtcggtgcgggccgactccatcatccacatcggtgccatcttcgaggagaacgcggccaaggacgacagggtgttccagttggcggtatccgacctgagcctcaacgatgacatcctgcagagcgagaagatcacctactccatcaaggtcatcgaggccaacaacccattccaggctgtgcaggaagcctgtgacctcatgacccaggggattttggccttggtcacgtccactggctgtgcatctgccaatgccctgcagtccctcacggatgccatgcacatcccacacctctttgtccagcgcaacccgggagggtcgccacgcaccgcatgccacctgaaccccagccccgatggtgaggcctacacactggcttcgagaccacccgtccgcctcaatgatgtcatgctcaggctggtgacggagctgcgctggcagaagttcgtyatgttctacgacagcgagtatgatatccgtgggcttcaaagctttctggaccaggcctcgcggctgggccttgaygtctctttacaaaaggtggacaagaacattagccacgtattcaccagcctcttcaccacgatgaagacagaggagctgaatcgctaccgggacacgcttcgccgcgccatcctgctgctcagcccacagggagcccactccttcatcaacgaggcygtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactctyaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcrttgtggacttcagcaagcggtacatggactattcagtggggattctaattaagaagcccgaggagaaaatcagcatcttctccctctttgctccatttgatttcgctgtgtgggcytgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaayaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaacyctcccttccasctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgcyccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgtgagagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataat

SEQ ID NO: 164 - DNA, 2399 bp, Homo sapiens
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatgtgagactttttcttggacgaattcaggtagctacacagaatctacacagcaaagttaacctgacacagaaaatccttgtgcaaataaatgcttagtaagtacacaggatgcacatgttgaatagagtatactggattggtgaaagaaaataataataatgagcatctaagtggttgggttttagagatcaatcaagaataattttaattttcttttgtatttgaaatgtaaatagttttcttttcgattaaaaaaatttcctataactgctaaacagttaaaaactttaaagtagtaaatgagtttatagaaagcatgtattcttgatttttgtgccttggtaaagttgataactatttatgaatatttgaccaaattattccagcatcagaataataagcaaaataactttgttagtgttttgttagactgtttatgaaatataacaagaaatactattttgtgttggatggcggttatttttaaacttaattaatacctgtgaaaaggcctcttacctttatgtatataattaaacaaaatcagagaaatgtatcagttgctcaagttatcaagcctgcattttgcagctatggtcttctacacactgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatsaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatcttaaactgtagaaacttttatagtttttgagat

SEQ ID NO: 165 - DNA, 5893 bp, Homo sapiens
  misc_feature (1)...(5893): n = A,T,C or G, or insertion/deletion polymorphism (see Tables 1-2)
ccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagygcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccggggga

SEQ ID NO: 166 - DNA, 6625 bp, Homo sapiens
  misc_feature (1)...(6625): n = A,T,C or G, or insertion/deletion polymorphism (see Tables 1-2)
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctgagaggtggggtgtcattctgtcatccaggctggagtacagtggcatgatcatcataactcgttacatcctggacctcctgggcccaggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagygcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccggggga

SEQ ID NO: 167 - DNA, 6538 bp, Homo sapiens
  misc_feature (1)...(6538): n = A,T,C or G, or insertion/deletion polymorphism (see Tables 1-2)
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagygcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccggggga

SEQ ID NO: 168 - DNA, 6508 bp, Homo sapiens
  misc_feature (1)...(6508): n = A,T,C or G, or insertion/deletion polymorphism (see Tables 1-2)
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagygcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccggggga

SEQ ID NO: 169 - DNA, 6733 bp, Homo sapiens
  misc_feature (1)...(6733): n = A,T,C or G, or insertion/deletion polymorphism (see Tables 1-2)
cccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctgagaggtggggtgtcattctgtcatccaggctggagtacagtggcatgatcatcataactcgttacatcctggacctcctgggcccaggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggatttgaacttctcgaagagctaccaacacccaagttcagctttggaggcagatctggaaacagtgtagcagcattggttttccaaaaaatccgccgcgcctagcgcccgggcccgcgacaccgcccgctaagcgccgggccgagttcacgcagccgcggtctggcggctccgcggcggcggcgggtgcgggcggcctggccggtgccggttaaagggacgagttgcaaacacttcaggaagtgacaagtcgatttcctcctccccgggagtcgctcgtacaaagcgctcggcgccggcaggcgagcgtgcgcgcggcggacgcgcggcgggcaccccggacgacttggcgagcgctggcggtgacggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagygcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagctgtgtggtttctgttgggtgtggtgaactggcaggtcccccctgctcacaggagcattagctctgggcgcagagagacctagactggacccttctgtcccctccaagcctcggggtctgaatcgataaaatggggctagcagacatcacagagctgtggagacgccggggga

SEQ ID NO: 170 - DNA, 768 bp, Homo sapiens
gctgttcttggtggagcgatttgtctggctaattccgataataaacgagactctggcatgctaactcattatgcgaccccagagtggtcagcgtcctsaaacttcttagagggacaagtggcattcagccacccgagattgagcagtaacaggtctgtgatgcccttagatgtccggggctgmatgtgtgttacactgsctcagcgtgtgcctaccctatgctggcaggtgcgggtaacccattgaacctcatttgtgatggggatgggggattgcaattattccccatgaatgagcaattcccagtaagtgtgggtcataagcttgcgttaagtccctgccctttgtaccacacagccactagctatgataatttgaattgcaggacacattgatcaccgacacttcgaaagcacttgtggccctgggttcctcacatgactatgcctgtctgagcgtcacttgctgatcaattgcccctgggggtgcctctgggttccttgggcggtggagcgagcacatggggtcagcggcgacgttgtctccccacccgaccctacttgaaaaatggaccaaggttaacacgttgatgagtcaggggctcccacgaaagccgctgtggagcaatgaagaaaatgtgttggttgatatagacagcaggacrgtggccatggaagttggaatctgctaaggagtgtgtaacaactcacctgctgaatcaactagccctgaaaatggatggtgctggagygtccggcccatacccgg

SEQ ID NO: 171 - DNA, 3247 bp, Homo sapiens
tgctccataactgctcctggaattcatgcagctgaagattcaacactgggctgctgatttcagctacccatgctttcttctttttctttttatttttttgagacagagtcttgctctgtagcccaggctggagtgcagtggcacgatctcgctcactgctacctccgcctcccatggcctggttcaagcaattctcctgcctcagcctcccgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtgtgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggagggagacagaactcagctcctctgagaggagaagtttacacagcacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgactcttccttggaaaaaataatctctcagaaaaggacttctaatacatcctcagggtagaatgtgtttccgtgattactttttttttttgagayggagtttcgctcttgttgcccaggctggagtgcaatggcgtgatcttagctcactgcaacctctgcctcccgggttcaagtgcttctcctgcctcagcctcccgattacaggcatgcaccaccatgcccggctaattttgtatttttagtagagayagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatrcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcrgattcaggatttacatttttggcaggaacagcacagaaatgatgctgtgacccacrtgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcagccctggagtcag

SEQ ID NO: 172 - DNA, 3407 bp, Homo sapiens
tgctccataactgctcctggaattcatgcagctgaagattcaacactgggctgctgatttcagctacccatgctttcttctttttctttttatttttttgagacagagtcttgctctgtagcccaggctggagtgcagtggcacgatctcgctcactgctacctccgcctcccatggcctggttcaagcaattctcctgcctcagcctcccgagtagctgggattacaggcatgcgccaccatgcccagctaatttttttgcatttttagtagagacagggtttcactgtgttggccaggctggtcttggactcctgacctcatgatccacccgccttggcctcccaaggtgctgggattacaggtgtgagccaccgtgcccagcctacccgtgctttcaaaggtcctgtatttccaccactttgtcaccacagacagccagaaggtcaagcagctggcctccaccttgcttccttctggtgcgcatatataggagcctgattagcatgtagaatcctagcagaatgggagtctttgaaataggtttcagctcaccagcctctagttacaggaggcattctagaaggacatgagtggattataactgccaaccaattgtatgtgccactgaggagatggagaagctgtgtccagagcggtgctataaggacaggagtgtgacacaggaaggcttaggtacgtggcctgggcccagtctcacatctcagggtcctgcttcaagtgggagcagttgagatctgtgacactcagcacctgggaggccgggtcagtgaagggagggagacagaactcagctcctctgagaggagaagtttacacagcacctggggccctccatttgggagtcacagtggaaaggagtcttggctgagctttggggcaggtgcaccttattttctttgcggtctgggatgccctcagagctgtgctcctctgctttgtccccatctgcctctggccctgggtaggaggcacttggagcatactttgtcttccttcagcagaggtgtgggcagggaatctacttgtctcttgttttcctttaagccgttgtgaaaatcaagtatgtgactcttccttggaaaaaataatctctcagaaaaggacttctaatacatcctcagggtagaatgtgtttccgtgattactttttttttttgagayggagtttcgctcttgttgcccaggctggagtgcaatggcgtgatcttagctcactgcaacctctgcctcccgggttcaagtgcttctcctgcctcagcctcccgattacaggcatgcaccaccatgcccggctaattttgtatttttagtagagayagcgtttctccatgttaggctggtctcaatctcctgacctcaggtgatctgcccgcctcggtctcccaaagtgctggaattataggcgtgagccaccacgcccagccttttgtgattacttttaaaattcagctgggtttgacacttggaggcttaatttctgggaatgactggacacagcatgtggctgggaccctctgaacaacctctgacctagtggagaagcaggtggtaatgactgtaggtatggatagggaaagactaggcgggcaaatacttgtcgtgtgtcaacaggtgtattttgctaaatgtcggggacacattccaagaggctaaaaagcaaatttctgtacattaggagatttgtgagtccttaggaaaggctcagaagagggctccacctagcacaatacctgacatagaaagtggtcagtgtctgcagaatgagtcggcatgaaccgtactttccttggcagggttattaggtggtaaatacctgcagaataatgggattgtactagggtttcttctggctttagaaacccatttgtttactaatagattcccagaggataccttgatctcaccaagctatttgccagaatgtctcctgatggcctcattgaagaaagggggactatgagccagatgctggtgccctgaagatttgtagtttgtgggatagtcttaacttggcagggtttgattaacagaatgaagtctgttccttagagggaagtctttgcttgctgccctgacctgctggacactgttaattgggatgaggtcaaagaaggcatagttaccacatttgcaggagaccctaacctggaaatagtaaattacataacattctttcaagtgtctcctcttttaaaaaagtattttgatatagtttcacacagagaaaacttgcaagaactcttgtatatcctttacccagattctccaactgtcaatactttgtcccatttactatttgctttagacattttgagatttgtttttgaaccatttgaggaaaacatcctacccttctacccataagtactttttcagtgtgtacatcttaagaatcaggactttctcttccataaccacagtccatcagatgcaggaaataagacaataatrcaatactatgacttagcccacagttcatgttcaaatcttaccgatcaccatgcctctttggtcttgcttaatctgaaacagttcagatttttattggactttctcggctttgacattttggagagtgaggtgttattctttagggtgtctgtcagtttacatttggggctttcccgtgatcrgattcaggatttacatttttggcaggaacagcacagaaatgatgctgtgacccacrtgcatcacattaggggcccatgatgtgggactgcgctttccttgctgctgttaacttttatcagttaaggttgtgttttccgcattgtgaagatactgtttttccttttaataagtaatttctggagggatactttgaaactaagtatcctgttcctcatcaaactttcacctactagtttcagcctcaattgatgattcttgctgaatcaattaccaagatggttgcaaaatggtgattttgcaacattatcgtttcttctaattattggcatgctcttataaggcagtttgttttctcgaccttagaagttttgtgttcatttagttattggcatagactcaagagtcttgtgttctatgtggagtctgttactgtgattccttgtgatgtccagattgtatgtatttggccaatcttgagttccttcaggaaacctcctggatcccatcattttaagggtgcttccttactttctagcatgagatattccaggcctaccttgtactttccctgctgcacatgcctgtagtcccagctgctcaggaggctgaggtgggaggatcacctgagtgagcctgaggaggtcaaggctgcggtgaaccatgatcacaccactgcactctagcctgggcaacagagtgagatcccgtttcaaaaagaaaaaaatctgaataaactatggactttagtt

SEQ ID NO: 173 - DNA, 2199 bp, Homo sapiens
gttctattattgtgagaactttagctgacccagtgacctggctcctatgggtacaagatggttagatacaccgggcagcagcggtggcttctgttcacagacaagtgaatgcctgccctgccgctagccccacctcacaaatatgaggctcactgttcgcaggggagcattttggaaccagctgggatgaagacagttttctgcaggtagcttttgtagccagatgcacagtagtgggttcccatcactccatgaggtcactgtagacctggaccattccagagaatcctttgtaatcagtctttaggtgtctcccagtccttcccagttcaacacgggtggcagcagatggcccagcccagggaaagtccacctgaccattagaaggactcatcctccagccaccaaagcaaggctrcagaggaagaggagcttgtcacaaacattaaccggctcagggctgggtaactgcattgacaaatttggaagcagcagggccagagagccaaggcccccgggtatccccattggccactggtggaggtgcactggaaggtcagggccttgacaccacagagccaagcaacacacacctccttgggcccaggycccagcacrgtggccctccagtgctggcaggtggcctcacccacagcaggggaggcgtgggtcctccaatgaccttcctgcccctgccagatgattttcacaactacctaactttggtgtttacttctaggtcctttggccaaatgcgttttcttctaagagttgttggcaaaatactgttacaagcttcttatgggacttttgtcctactgtggcctggttaaaggctttgtcctcctgtttaatccacttccgtggttttgctgtcatttctcttgatgccrtattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaagcctgctcctgccagcactcagggagggagtgtgtgcttcccaagagcctgcccccttggcccatgcaaactttctccatggcaggtgtccgtgaaggtctcccaggccctatgggctgtccagctctttgcacacattcttcccgcttgcaggaatggaatccaaacacctgatacggaatgatgacttggcagtggggagtggggcagcttgtctccrctaacttaggaccaaaactaggaaactcaccatgagcatgtgttggagatcagctgtggcctccagcccctgtacacacagaggcaagccccacctctgacagagccagtcaccgttcagtaggagcttgtcttccctgggcccccaggtgggaaaggctgggctcttagtcctacaagtaaaggcgctgttaggagcaaggagcaggcttagctgggtccacagagggactaagctccttagtgacctgttactgcctcatctacggagtttgaactccattcaccatcacctttgagaatttggccttgttttaactaaggattgttgaagttaattataacaagggaccatcctcaccctgtgtttgctttgttccattaaacgtgcgtttggcctaatgaagtcagtgaatgttcctcttttttcttttttggtttctttgactgatttttggatgatatatgttgctttatttctcccattttctttgattactgtggacaaaggaaaacactgaggcaaaagtaggtcgtcaatcacattactttgacccagttgtgcagaacccctttctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcactttttatagaagaattgtatttaatttctttcttttatgaaagattatttcaagtaaaaatagctctgtaatctgtgtgacatggcttctccattacctgacacagagagaagctttgatgcctactcaataaaattaacatgtttgtaaagt

SEQ ID NO: 174 - DNA, 1080 bp, Homo sapiens
  misc_feature (1)...(1080): n = A,T,C or G, or insertion/deletion polymorphism (see Tables 1-2)
gtgatatcactgggctccagcaagggcaaggccagcttcgcaggtgacgatgccccgtyggccgccttcccctccatcttggggcgcccgcgacaccagggcatgatggtgggcatgggccagaaggactccaatgtgggcgatgaggcccagagcaagagaggcatcctgaccctgaagtaccccatctagcacggcatggtcatctactgggatgacatggagaagatctggcaccacaccttctacaatgagctgcatgtggctttcgaggagtaccctgtgctgctgaccaaaggccccctgaatcccaaggccaaccatgagaagatggcccagattatgttggagaccttcaacaccccacccatgcacgtggccatccaggtcgtgctgtacctgtactcctctggccataccactggcatcgtgatggactctggcgacaggtcacccacattgtgtgcatatatgaggggcacgccctcccccacaccatcctgcgtctggatctcgctggccaggacctgaccgaccgcctyatgaagatcctcacattgtgcggctacagctttaccacccgcagagggagagntcctgtgtgacatcatcaaggagaagctgtgctaagtcgccctggactttgagcaggagatggccccacgggtcctcctgggagaagagctatgagctgtcagatggccaggtcatcaccakcagcaacaagcggttccactgccccgaggcgctcttccagccttctttcctgggcatggaatcctgtggcatctacaaaactaccttcaaatccatcgtgaagtgtgacgtggacatccacaaagacctgtacgccaacacagtgctatctggcagcaccaccatgtaccctggcatcgctctgcaggatgcagagggggatcactgccctggctcccagcatgaggaggatcaagatcattgctccttctgagtgcacatactctgtggatgcgtggctccatcctgacctcgttgtccaccttccagcagttatggatgagcaagcaagaatatgatgactccagtccttccattgtccac

SEQ ID NO: 175 - DNA, 2711 bp, Homo sapiens
  misc_feature (1)...(2711): n = A,T,C or G, or insertion/deletion polymorphism (see Tables 1-2)
acgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctamgatggaagacacagtggagtactgcctgttcctgataccagatgagtcaagggactcagataaacataaagagattcttcagaagtacattgagagaataatcactcngtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcwccaagaaaatctggagcagaatcttggttacccaccacacccccaacaattccacaagcattgaatataatcacagcacattcagaaaaaatacttgcttcagaatctatacgagctgctgtgrataggcgcatcagagggtaggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatcygagtctgtttcyaaggaggagaaggagcagaactatgacttaactsaagtctcagagagcatgaaagctttcatatccaaagtctcaacccacaagggagcagagctgcctcgaraaccttctgargctccaatcacttttgatgcagattcttttcttaattattttgataagattttagggccaaggcctartgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagatkctggtacgggagaatctgttatggcaccagtagatgtwgacctgaacctggtttcaaatatattggaatcctatagctcccaagctggactggcaggacctgcttccaatcttttacaaagcatgggagtgcagctgcctgacaacaccgntcacagaccaacaagtaagccaacaaaaaattaaccagcacatttagcttctcttttttctttttaaataaatattgaatatgattctgttcatttctagtttagattactcatttngtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactsattcactttttcaatttttttaatgaggcayaacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccacwagtctactttctgtctctatggatttgcctattttggatattt

SEQ ID NO: 176 - DNA, 2708 bp, Homo sapiens
  misc_feature (1)...(2708): n = A,T,C or G, or insertion/deletion polymorphism (see Tables 1-2)
acgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctamgatggaagacacagtggagtactgcctgttcctgataccagatgagtcaagggactcagataaacataaagagattcttcagaagtacattgagagaataatcactcngtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcwccaagaaaatctggagcagaatcttggttacccaccacacccccaacaattccacaagcattgaatataatcacagcacattcagaaaaaatacttgcttcagaatctatacgagctgctgtgrataggcgcatcagaggggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatcygagtctgtttcyaaggaggagaaggagcagaactatgacttaactsaagtctcagagagcatgaaagctttcatatccaaagtctcaacccacaagggagcagagctgcctcgaraaccttctgargctccaatcacttttgatgcagattcttttcttaattattttgataagattttagggccaaggcctartgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagatkctggtacgggagaatctgttatggcaccagtagatgtwgacctgaacctggtttcaaatatattggaatcctatagctcccaagctggactggcaggacctgcttccaatcttttacaaagcatgggagtgcagctgcctgacaacaccgntcacagaccaacaagtaagccaacaaaaaattaaccagcacatttagcttctcttttttctttttaaataaatattgaatatgattctgttcatttctagtttagattactcatttngtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactsattcactttttcaatttttttaatgaggcayaacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccacwagtctactttctgtctctatggatttgcctattttggatattt

SEQ ID NO: 177 - DNA, 2200 bp, Homo sapiens
  misc_feature (1)...(2200): n = A,T,C or G, or insertion/deletion polymorphism (see Tables 1-2)
caaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctamgatggaagacacagtggagtactgcctgttcctgataccagatgagtcaagggactcagataaacataaagagattcttcagaagtacattgagagaataatcactcngtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcwccaagaaaatctggagcagaatcttggttacccaccacacccccaacaattccacaagcattgaatataatcacagcacattcagaaaaaatacttgcttcagaatctatacgagctgctgtgrataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatcygagtctgtttcyaaggaggagaaggagcagaactatgacttaactsaagtctcagagagcatgaaagctttcatatccaaagtctcaacccacaagggagcagagctgcctcgaraaccttctgargctccaatcacttttgatgcagattcttttcttaattattttgataagattttagggccaaggcctartgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagatkctggtacgggagaatctgttatggcaccagtagatgtwgacctgaacctggtttcaaatatattggaatcctatagctcccaagctggactggcaggacctgcttccaatcttttacaaagcatgggagtgcagctgcctgacaacaccgntcacagaccaacaagtaagccaacaaaaaattaaccagcacatttagcttctcttttttctttttaaataaatattgaatatgattctgttc

SEQ ID NO: 178 - DNA, 592 bp, Homo sapiens
gctgtacaaggtctttttctttgttgtcatggttgattttgtacatttcagcatttgcatcatacaaaggggggagcaacagccatggcttttggtcaggttcaggggggctgagggggtgctcctcccctccccccaggcactgacacattgaaaggaagcagagcaacaatgacacagcacggatgtgggaaaggggatcccccacgsgggcaggatggtccatctcaccggggtctcaccaggactccccgctcccacccagggccagcacgagcacctcccgttttctccccagtgcagagcgtggggtgacaggagtgggactggagcaggggacatttggtgggaggcatgtcctcaggcctgggagaccaggctggccccagcctccctgtgcggtcaggggcctgtggaaccctagaggatggagcaggtggacagcaggggtgggcaaccctgccagctgggtactagggctattggggctggagggtcyaccccactgtactctagccacaaggctgtggggtggctgctttgcccaccagctgtccccctgataggggatctgggctgcaatacttctgta

SEQ ID NO: 179 - DNA, 1420 bp, Homo sapiens
agaacatgagtaataccctcaaattccaaatccccgccaaaaaataaagaaacgcgcgcatcatgggcctacaatttcttttcccgcccagagcctgcctgggaaagcccctgacccagagagttgggggaaaggcggcccaaaccacacgtgtgcgccgcaaggctgggcctgtctcagcccacttcccgtcgccacccccaacggcctgagctcccccggagcctcactcgggcctttcctcagrccctcctgtctgctccacgtggggcgccggggcctcgaaccgcccgtcccctccagccgagtttccccacccgccaggccaccgcggcrtcggggtcccatacctgatgctgttgtcgcycctgctggtaaggcttaattggcccctggtggcaacgccgcgtccggatcttgccgccaccgccccctccgactcctccggctcccgaggccatggcggagcctccgccgcttcccgctccggggcgggtaagggggcgggagaggcagaggcggaggccttagagagcctcccccgccgcccggccccggcccaaaagtccgcccgcgctgtccacacagtgggcacaagcaccccaggaaccgcgaggttgcgagcaggagcggagagagggtgagtgctggcagcggggaagggggtggcggccgcagaggccgaggaggctccggtccggccgcctctgcggacccccgcctctgtgtgtgtcacggtctctatggagatctcccgcagaggacagcacgaacagttccccgcggtgctgaggcctaactcgaccgccgactggtgggagttcttccgtcgccctagccgtagctgccgcagttgaagccgctggcgacgcccgcctacccctcccctgtgcgcacagcgcccgccccgccgccgtcgtcgtcgtcgtccctgcagcctccgccgccgttgcgcctattacccctgctaaggcggctgccgcggtcgcgagccagaatgtcgtcactcatcggcgcccgacgcatttgcatcatcatgctgcgacgagctgataggcaaagaggaagggctggtcgagtccacgctctcggccgcgcggcacgctgggaaacgtagttcaacaacggaacgcggcttctcggaaaggaagagggacggggaaggagatctccggggcgccgcagaggcacaaagccaaggggtacttttgctgttcttggctgtaaattagactttgaaaagacacttaacataaaaacagtaacctcttcccattctccttctccctgtcggttggttaagtaggcaggaagtaagcagacagtaaaatcaaagacaagagctaatgatttaagaaggaggaaaaaaaaatctgtggttgaaaaataaagtccatgatccttagaattagaaaatata

SEQ ID NO: 180 - DNA, 2778 bp, Homo sapiens
cgcgtctgctaacgtagtccctcagtgcgcatccggacktaggaggtggaggttgtggaattcgccgttcgaaagcagggactaaaagccccacttcgtcttacgttccgaaaggaaggcgtctgttgagcctttctctcagtcgtgagggaggcgtcgacggcgtgcgatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagycgccgttaccgagagaggcgctacgggttcamcaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactrtcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttcygtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggcrgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttt

SEQ ID NO: 181 - DNA, 1382 bp, Homo sapiens
cgcgtctgctaacgtagtccctcagtgcgcatccggacktaggaggtggaggttgtggaattcgccgttcgaaagcagggactaaaagccccacttcgtcttacgttccgaaaggaaggcgtctgttgagcctttctctcagtcgtgagggaggcgtcgacggcgtgcgatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagycgccgttaccgagagaggcgctacgggttcamcaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaraaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattctta

SEQ ID NO: 182 - DNA, 1465 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgcckcaggagaaggattcgccctckacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgyacccggaggagcacagcagatggagggacagmtccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgraaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattctta

SEQ ID NO: 183 - DNA, 1261 bp, Homo sapiens
cgcgtctgctaacgtagtccctcagtgcgcatccggacktaggaggtggaggttgtggaattcgccgttcgaaagcagggactaaaagccccacttcgtcttacgttccgaaaggaaggcgtctgttgagcctttctctcagtcgtgagggaggcgtcgacggcgtgcgatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagycgccgttaccgagagaggcgctacgggttcamcaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaraaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttt

SEQ ID NO: 184 - DNA, 1450 bp, Homo sapiens
gtagtggcttcgtcctccacttttctcttcctccgctgatgcctcccagctctcgtcagcctcctgctggccatctccttaacaccaaacactatgccttcaattcagttgcagagttttgatggagagatatttgcagttgatgtggaaattgccaaacaatctgtgactatcaagaccacgttggaagatttgggaatggatgatgaaggagatgacccagttcctctaccaaatgtgaatgcagcagtattaaaaaaggtcattcagtggtgcacccaccacaaggatgaccctcctccccctgaagatgatgagaacaaagaaaagcaaacagacgatatccctgtttgggaccaagaattcctgaaagttgctcaaggaacactttttgaactcattckggctgcaaactacttagacatcaaaggtttgcttgatgttacatgcaagactgttgccartatgatcaaggggaaaactcctgaggagattcgcaagacrttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaaagcagtggcaagtcaattgtattagcagaatattgtcctcattgcatgtgcagtttgagtacagattccaaacctatggctgagtttcttctagtatgatcaaaagtttcttttttttttttttgctctgaataaaactgaactgtgggttctctataagtggcattttgggttttccttcttttttgtaaagtaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagttaactaggatgtcttccagcctcctgcagtcaaggagtaccactgtaatgattagtctgtatgtagcagggctcccttcattgcatttgaggacttgttttctttttctttaattttatttttaatcctcttagttttaaatatattgcctagagactcggttactacccagtttgtggttttttgggagaaatataactggacagtttgttagcttttcaattaaaaagacacttaacccatgtgggatgtcatgtttttataatcattkttcccatgtggagaaaattattcacactacttgcatgtaaaaaataatttaactttttacattaaaatatgtggtaaaacccagaaagcatccatcatgaatgcaagatactttcaataaaaagtaagttata

SEQ ID NO: 185 - DNA, 7177 bp, Homo sapiens
  misc_feature (1)...(7177): n = A,T,C or G, or insertion/deletion polymorphism (see Tables 1-2)
gagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaaccnccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaarcttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagatygacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgyatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcmcaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctktctcctctctctcctcctttgaccttctcctcgaccagccatcatgacatttaccatgaatttacttyctcccaagagtttggactgcccrtcagattgttnctgcacatagttgcctttgtatctctgtatgaaataaaaggtcatttgttc

SEQ ID NO: 186 - DNA, 8066 bp, Homo sapiens
  misc_feature (1)...(8066): n = A,T,C or G, or insertion/deletion polymorphism (see Tables 1-2)
tcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttakgagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtckatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcacttgcatgctcatgggcaaggatctcattgtgctggaaaagcagcagagtgagacaaaactggacaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaaccnccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaarcttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagatygacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgyatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttcctttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgt

SEQ ID NO: 187 - DNA, 9743 bp, Homo sapiens
  misc_feature (1)...(9743): n = A,T,C or G, or insertion/deletion polymorphism (see Tables 1-2)
ccggtcgggttctgggaggcacmgcctcggggttgcgggccgggtgcggctcggcggtggaggactcacttcctgctccatccccggctgggccctggggcggaactgatgacgcttgataatgtggctggggacttcagggaagagtgggttacctggacactgcttagagaatcctctccaggaatgccacccagcacagttagaagaatgggctctcaaaggaatttccaggcctagtgtaatctcccagccggagcagaaagaagagccatgggtcctaccactccaaaactttgaggcgaggaagatccygagggaaagccacacagactgtgagcatcaggtggcaaagctcaatcaggacarttctgaaacagcagaacaatgtggaacatcctcagaaaggaccaataaagatctttctcatactcttagttggggaggaaactgggagcaaggcctagaattagaagggcaacatggaacccttccaggagagggccagctggagtccttttcacaggagagggatttaaacaagctcctggatggatatrtaggagagaagcctatgtgtgcagaatgcgggaaaagctttaaccagagttcctatctcataagacacctaagaacccacactggcgagaggccctatacgtgcaytgagtgtgggaaaggcttcaaacagagctcagaccttgtcacccatcgcagaacacacacaggagagaagccctaccaatgcaaggggtgtgagaagaaattcagcgacagctcaacactcatcaaacatcagagaacccacacaggggagagaccctatgagtgcccagagtgtggaaagacttttgggcggaagccacacctcataatgcaccaaagaacccacacaggcgagaagccctacgcgtgcctggaatgtcacaaaagcttcagtcgaagctcaaatttcatcactcaccagaggacccacacaggggtgaagccttacaggtgtaatgactgtggggagagttttagccagagctcggatttgattaagcaccaacgaacccacacgggagaacggcccttcaaatgcccggagtgcgggaagggcttcagagatagttctcattttgtagctcacatgagcactcattcaggagagaggcctttcagttgtcctgactgccacaaaagcttcagtcagagctcacatttggtcacgcaccaaagaacacacacaggtgagagaccttttaagtgcgaaaactgtgggaaaggattcgccgacagctccgccctcattaagcaccaacgaatccacaccggagaaagaccctacaaatgtggagagtgtgggaagagcttcaatcagagctcccactttattacccatcagcgaatccacttakgagacaggccctatcgatgtcctgagtgtggcaagaccttcaatcagcgttcccatttcctcacacaccagagaacgcatacaggagaaaaacctttccactgtagtaaatgtaacaagagcttccgtcagaaagcgcatcttttatgccatcaaaacacccatttgatttaggaagtagtctttggtgttcagctgctcccttgcacattttcattgctactgtcttcaagcaccccaaatagagaaaacctgggcgtcagtggctcaatttgggccctgatctattctccctctttcttgtckatgttataacagagaggataaacttaaagggtccaaataacggtccgaatacaaaaggcattccttcagtgtgtgactgactcttagggaaatgtgagtttaatagttgatgcccgccaggcgtggtggctcacccctgtaatcccagcacttttgggaggccaaggtgggtggatcacttgaggtcaggagttgagaccagcctggtgagcatggtgaaacctcatctctactaaaaatgcaaaaattagctgggcatggtggcacgtgcctgtagtcccagctactcgggaggccgaggcagaagaatcatttgaactcagaaggtgcaggttgcagtgagttgagatcatgccactgcactccagcctgggcaacagagagagactctgtctccaaaaaaattaaaaagttgatgcctagttactaaatgagaagtgagaaaaatgtggcctagagatcacatgttcaccacctagtacagtgcctggcacaacatagatgctcaataactaaatggtcccatcattattaatgattaatagttgaggtcttatataaaggctttaatgcagtacctggcccttaaaagacactcagtacaagattggtggcttttatcagtcttattactcaattagaaatttattagtgtagtccccccgccccaaactcagaacgtgaaagaaattagattggaactagaaggtttggggttggaatacacaaattgaataaaatggaaatgcactgccagttcagtgctgtgcaggcattagtcaccagaggtctcacttgcatgctcatgggcaaggatctcattgtgctggaaaagcagcagagtgagacaaaactggacaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaaccnccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaarcttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagatygacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgyatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcmcaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctktctcctctctctcctcctttgaccttctcctcgaccagccatcatgacatttaccatgaatttacttyctcccaagagtttggactgcccrtcagattgttnctgcacatagttgcctttgtatctctgtatgaaataaaaggtcatttgttc

SEQ ID NO: 188 - DNA, 1338 bp, Homo sapiens
acaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagaygaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacrctgggtcagcccaacaycctcatytgtcttgtggacaacatctttcctcctgtggtcaacatcacmtggctgagcaatgggcastcagtcacagaaggtgtttctgagaccagcttcctctccaagagtgatcattccttcttcaagatcagttacctcaccttcctcccttctgmtgakgagakttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtgaatcccatcctgaaaaagaaggtgttacctactaagagatgcctggggtaagccgcccagctacctaattcctcagtaacatcgatctaaaatctccatggaagcaataaattccctttaagagatctatgtcaaatttttctatctttcatccggggctgactgaacctatggctaagaattgtgacactctcatgtttcaagccaatttcatctcatttcccagatcatatttcatatccagtaacacagaagcaaccaagtacaatatagcctgataatatgttgatttcttagctgacattaatatttctttcttctttgtgttctcacccttggcactgccgcccatccctcaattcaggcaacaatgaagttaatggatactctctgccctttgctcagaattgttatagcaaaaattttaaaaccaaaaaataagtttgtactaatttcaatatggcttttaaaagtatgatggagaaataaattaggataaaggaactttgaatcacaaa

SEQ ID NO: 189 - DNA, 767 bp, Homo sapiens
acaattgctctacagctcagaacagcaactgctgaggctgccttgggaagaggatgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagaygaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatggagaggaaatgctggtaggaagactcttccaggatgtaatgcagaagaagctcagggcagagctattcacactttacaccagtgctgtttcctcaccatagaggttcctgaggtcacagtgttttccaagtctcccgtgacrctgggtcagcccaacaycctcatytgtcttgtggacaacatctttcctcctgtggtcaacatcacmtggctgagcaatgggcastcagtcacagaaggtgtttctgagaccagcttcctctccaagagtgatcattccttcttcaagatcagttacctcaccttcctcccttctgmtgakgagakttatgactgcaaggtggagcactggggcctggatgagcctcttctgaaacactggg

SEQ ID NO: 190 - DNA, 768 bp, Homo sapiens
atgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagacgaggagttctacgtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaccctcatctgtcttgtggacaacatctttcctcctgtggtcaacatcacmtggctgagcaatgggcastcagtcacagaaggtgtttctgagaccagcttcctctccaagagtgatcattccttcttcaagatcagttacctcaccttcctcccttctgmtgakgagakttatgactgcaaggtggagcactggggcctggacgagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacaccaagggctcttatga

SEQ ID NO: 191 - DNA, 14321 bp, Homo sapiens
ccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgcygacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggaygtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacaggaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgargccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgacaggcrcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcrgagcggcgcctgcggcaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcrcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcragggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcggaggaggagcggcggcgccgtgaggctgaggagcgcgtgcagaagagcctggcggccgaggaggaggccgcacggcagcggaaggcggcgctggaggaagtcgagyggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctcwgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggctgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcargmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaat

SEQ ID NO: 192 - DNA, 14760 bp, Homo sapiens
ccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgcygacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggaygtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgargccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgacaggcrcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcrgagcggcgcctgcggcaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcrcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcragggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcggaggaggagcggcggcgccgtgaggctgaggagcgcgtgcagaagagcctggcggccgaggaggaggccgcacggcagcggaaggcggcgctggaggaagtcgagyggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctcwgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggctgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcargmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 193 - DNA, 14641 bp, Homo sapiens
atggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgygtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggccyggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgcygacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggaygtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacaggaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgargccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgacaggcrcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcrgagcggcgcctgcggcaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcrcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcragggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcggaggaggagcggcggcgccgtgaggctgaggagcgcgtgcagaagagcctggcggccgaggaggaggccgcacggcagcggaaggcggcgctggaggaagtcgagyggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctcwgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggctgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcargmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaat

SEQ ID NO: 194 - DNA, 1446 bp, Homo sapiens
cgctgtcacaccctgtagcgcgggagcttctcgcagcgccccgggccttctcgtggtaccctgcctgctgcctttgcccccgcactgactgcccggctccagcagccatggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgygtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggccyggagcctgccccagccacaggtcagctgcaccctgaccccaagtcatgatgggtggcaagtaggggtctggttgtcgggtcttgggcctgggcctgggctggagtggttggagtggtcagccggcttgcggagcgtcgctcacaccagcaggtggccccccctagccgagggtcagggggtgcgcttgctgatgggcccatgtggcccctcctcctcggctggggaccttcgggtgtgtaggccaaggaggagcctgtggcccaggcacaccccggggcgccccctcccctctctccaacactgcccttgccttcgccccctccgcctcctctcctgtcccagtgacctgtcttccccgaggctcctcggcactgaggtgggggtgtgcgaggaggtgctggcgccggttgggtgtggccctcctccagcacatggcctggccgcctcccttgccgcgggggttgatgggtgaggcttggtgccgcacagagtgcccggtgtgaccggtaactgagtgcttggccagcttggacttggtggtggctggggacggccctgggcgggatggggagaagcgcagggtccaggcaggaggctcctccggcagggcagaggccaggctgtggtgtggtgtctgctggcccagcctggggcctagataggcctttcccggtacgaaccaggtcgcacaggacaggacgggtcctgtcatcccagaggcttccagagaccctttgctctgccccttctctgtggcctccctctgtccacaagcacctgtaccagcaggacccaggtgggcagatgtgtcccctgcagcccgaggctcacacac

SEQ ID NO: 195 - DNA, 14800 bp, Homo sapiens
cgcccgggcaggtggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcagggatgatgacatcgcygacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggaygtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcgtggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgargccaccaaggcctctctgaagaagctgcgggcccaggccgaggcacagcagcccacgttcgacgccctgcgggatgagctgcggggggcacaggaggtgggggagcgactgcagcagcggcacggggagcgggacttggaggtggagcgctggcgggagcgggtcgcccagytgcttgagcgctggcaggctgtgctggcccagaccgacttgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgacaggcrcaggaggaggccgagcgcttgcggaggcaggtgcaggacgagagccagcgtaagcggcaggcggaggtggagctggcctcgcgcgtgaaggccgagaccgaggcggcgcgcgagaagcagcgggccctgcaggccctggaggagctgcggctgcaggcggaggaggcrgagcggcgcctgcggcaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcrcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcragggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaagagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcggaggaggagcggcggcgccgtgaggctgaggagcgcgtgcagaagagcctggcggccgaggaggaggccgcacggcagcggaaggcggcgctggaggaagtcgagyggctgaaagccaacgtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcaggcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccgagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctcwgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggctgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcargmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcgcccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 196 - DNA, 2429 bp, Homo sapiens
cgaaacccaagtcgtcagagtcggagtcatactccaagtcgtcgacgaaggtctagttctgtgggtagaagaaggagctttagcctttccccaagccgccggagccacacccccagcckccagagaagatcaaagtctgtggtaagaagacgaagcttcagtatctcaccaatcagattaaggcgatcaagaacacccttgagaagaaggtttagcagatctcccatccgtcgtaaaagatccaagtcttctgaacaaggcagaccatccaaacgtctaacagatttggataaggctcaattacttgaaatagctaaarctaatgcagctgccatgtgtgctaaggctggtgtccctttcccgccaaacctaaagcctgcacctccacctactatagaagagaaagttgctaaaaagtcaagaggacctactatagaagaactaactgagaaatgtaaacagatcacacagagtaaagaagatgatgatgtagtagtgaataaacctcatgttttggatgaagaggaagaagaacctcctttttatcgtcatctctttaaactcagtgaacccaaacccatttttttcaatctgaatattgctgcagcaaaaccagcttcaccaaaaagccaggtaaccttaacaaaagaattccctgtatcatctggatctcaacattggaaaaaagaagcagatagtgtttatggagaatgagttcctgtagagaaaaatggtgaagaaaacaaagatgatgataatgttttcagcagcgatttgccctcagagcctgtggacatctctacagcaatgagtgaacgggcactcgctcagaaaagactcagtgagaatgcatttgaccttgaagacatgagcatgttaaatagagctcaggaaaggattgatgcytgggctcagctgaactctattcctggccagttcacagkaagtacaggagtacaggttttgacacaagaacagttggccaatactggtgcccracctggattaaaaaggatcagttcttaagagcagccccggtaactggagraacgggagccgttttgatgaggaaaatgggctggagagaaggagaaggattaggaaaaaacaaagaaggcaataaggaacccatcctagttgattttaagacagaccgaaaaggtcttgttgcagtaggagaaagagcaaaaaagaggtctgggaacttctctgctgcaatgaaagatctgccaggcaaacatcctgtgtctgctttgatggaaatctgaaataagagaaggtggcaaccacctgaatttctattggtccatgatagtggccctgatcatygcaaacgttttctctttagggtattgagaaatggaagcccttaccagcccacccaactttgccagccttaataagaagcatgctaaagacacagcagctactgtggttcttcaagcaatgggccttgtaccaaaggacctcatggctaatgccacctgcttcaggagtgcctcacatagatagattgaggttttataataatcatttcagataattttactctgcctcacaatgtgtttcctctttaatgttgtaaatatttggcaatttaagacattgtgtaaaaagcaatctgtagaaacatctccaggctttgatttttgtaccatggaaattgtatttaaccatacagggttttggtatgtttatattgtttatcttagtgatgtatttgtttaagtggctaacatccaaacgattgtttgaaggcattagagtaatcttcagtgtggaatgttaaataacgcttttatactgtattttgtactatgatgtaactccccttccttatggctagcctactgtaacacttgcctgtaatcagtgaagggctgtgcaccttgtactatttcacagtgggttctgctggacagatactggcccagtgttattgaggtgatcaagcaagagctgttccacagggctaaagcaaccatctcccctcaaaattttgtagaggttctaaaaagaaagggtatgaggtgtgatgatcagcactaagtcctgcattcctgttaaagccacttgggtcataagaagggagtaaaaaatgaagtctgagtagaattctactattgctgaggccaagtacatttagtatggcatcgagttgtgatatagttttactttgatgtgcattttgaatttcagctacacctagatagacataaaatgataattaaaatgctgtaaccaacttatctaataaaattggcaaccagccactattctgttgactatgagaaagttaaagtttatgttaatttttagggtctgataggatatttcatgtgtattacagtggtattcatatgctatgtttctaaactttattttcaaaagcttaaggcccaaatactaacttctctggaataataaaa

SEQ ID NO: 197 - DNA, 3694 bp, Homo sapiens
caggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccakactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagakgagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggycttccaaggcatgcttcggaaactggacatcaaaaacgaagacgatgtgaartcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccaagtgctccccattgattgaagagtcactgtctgaaagaagcaaagttcagtttcagcaacaaacaaactttgtttgggaagctatggaggaggacttytagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttamtaaaagattttcagctgaatggaactcattagctgtgtgcatataaaaagatcacatcaggtggatggagagacatttgatccyttgtttgcttaataaattataaaatgatggcttggaaaagcaggctagtctaaccatggtgctattattaggcttgcttgttacacacacaggtctaagcctagtatgtcaataaagcaaatacttactgggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctyacttaaatttacagaaagaggtgagctgtgttaaacctcagagtttaaaagctactgataaactgaagaaagtgtctatattggaactagggtcatttgaaagcttcagtytcggaacatgacctttagtctgtggactccatttaaaaataggtatgaataagatgactaagaatgtaatggggaagaaytgccctgcctgcccatctcagagccataaggtcatctttgctagagctatttttacctatgtatttatcgttcttgatcataagccgcttatttatatcatgtatctctaaggacctaaaagcactttatgtagtttttaattaatcttragatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggttt

SEQ ID NO: 198 - DNA, 3401 bp, Homo sapiens
caggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccakactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagakgagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggycttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttytagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaaaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttamtaaaagattttcagctgaatggaactcattagctgtgtgcatataaaaagatcacatcaggtggatggagagacatttgatccyttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctyacttaaatttacagaaagaggtgagctgtgttaaacctcagagtttaaaagctactgataaactgaagaaagtgtctatattggaactagggtcatttgaaagcttcagtytcggaacatgacctttagtctgtggactccatttaaaaataggtatgaataagatgactaagaatgtaatggggaagaaytgccctgcctgcccatctcagagccataaggtcatctttgctagagctatttttacctatgtatttatcgttcttgatcataagccgcttatttatatcatgtatctctaaggacctaaaagcactttatgtagtttttaattaatcttragatctggttacggtaactaaaaaagggccccacttcccaattcattaggtatgactgtggaaatacagacaaggatcttagttgatattttgggcttggggcagtgagggctta

SEQ ID NO: 199 - DNA, 4148 bp, Homo sapiens
caggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccakactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagakgagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggycttccaaggcatgcttcggaaactggacatcaaaaacgaagacgatgtgaartcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttytagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttamtaaaagattttcagctgaatggaactcattagctgtgtgcatataaaaagatcacatcaggtggatggagagacatttgatccyttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctyacttaaatttacagaaagaggtgagctgtgttaaacctcagagtttaaaagctactgataaactgaagaaagtgtctatattggaactagggtcatttgaaagcttcagtytcggaacatgacctttagtctgtggactccatttaaaaataggtatgaataagatgactaagaatgtaatggggaagaaytgccctgcctgcccatctcagagccataaggtcatctttgctagagctatttttacctatgtatttatcgttcttgatcataagccgcttatttatatcatgtatctctaaggacctaaaagcactttatgtagtttttaattaatcttragatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtctyacgcttmtctcagggaaaaacatgcagtsctctagtgtttcatgtacattctgtggggggtgaacaycttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacagg

SEQ ID NO: 200 - DNA, 1842 bp, Homo sapiens
cccattaggtgacaggtttttagagaagccaatcagcgtcgccgcggtyctggttctaaagtcctcgctcacccacccggactcattctccccagacgccaaggatggtggtcatggcrccccgaaccctcttcctgctrctctcgggggccctgaccctgaccgagacctgggcgggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagttctcayaccctccagtggatgattggytgcgacctggkgtccgacggwcgcctcmtccgcgggtatgaacagtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcgcggacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggaagcagtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgagggvaacagbggacatagctgtgctatgaggtttctttgacttsaatgtattgagcatgtgatgggctgtttaaagtgtcacccctcactgtgactgatatgaatttgttcatgaatatttttctgtagtgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaa

SEQ ID NO: 201 - DNA, 937 bp, Homo sapiens
gccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccaagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggaagcagtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaatggaagacatgagaactttcc

SEQ ID NO: 202 - DNA, 868 bp, Homo sapiens
attaggagatgtcctggactcacacagaaactcagggctatggaatgaagggcaagctcactctctggcaacaagctccctggrgtgatttttcttctagaagagtccacggggacagggtttctcttctccctctcccaacctgtgtcgggtccttcttcctggatactcaccaggctgccccagttctcactcccattgagtgtcgggttcctagagaagccaatcaatgtagccgcggtcccggttctaaagttcccacgcacccaccgggactccgattctccccagtcgccgaggatggtgtcatggcgccccgaaccctgcttctgctgctctcgggggccctggtcctgacccagacctgggcaggcttccactccttgaggtatttccacaccaccatgtcccggcccggccgcgcggatccccgcttcctctccgtgggcgacgtggacgacacgcagtgcgtgcgsctcgacagcgacgccacgagtcccaggatggagcmggaggggccggaatattgggaagaggagacagggaccgccaaggccaaagcacagttttaccgagtgaacctgcggaccctgagcggcyactacaaccagagtgaggcctgtgagtgacaccggccgggggcgcagrtcactacccstcyacatcccccacgraccgcccgggtctccccgagtctctgggtccgagatccacgccgaggcagcggaacctggagaccctttacccgggagaggcccaggagccgttacccggtttcattttcagccaaaatccccgcaggggctgccagccacacagagtcatggacaggtctctacagacacaacttagtgccagcttggatgaa

SEQ ID NO: 203 - DNA, 729 bp, Homo sapiens
atggcgccccgaaccctgcttctgctgctctcgggggccctggtcctgacccagacctgggcaggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagttctcayaccctccagtggatgattggytgcgacctggkgtccgacggwcgcctcmtccgcgggtatgaacagtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcgcggggccatcttcccagcccacattccycatcrtgggcatygttacygtcctggttgttctaggtgctgtggtcactgctgtgatgtggaagaataagaccccaggtaggaaaggggtgagt

SEQ ID NO: 204 - DNA, 1506 bp, Homo sapiens
cccattaggtgacaggtttttagagaagccaatcagcgtcgccgcggtyctggttctaaagtcctcgctcacccacccggactcattctccccagacgccaaggatggtggtcatggcrccccgaaccctcttcctgctrctctcgggggccctgaccctgaccgagacctgggcgggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagttctcayaccctccagtggatgattggytgcgacctggkgtccgacggwcgcctcmtccgcgggtatgaacagtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcgcggacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggaagcagtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaatggaagacatgagaactttcc

SEQ ID NO: 205 - DNA, 1492 bp, Homo sapiens
aacatatagtaacatagtgtggtactttgtcttgaggagatgtcctggactcacacggaaacttagggctacggaatgaagacgccaaggatggtggtcatggcrccccgaaccctcttcctgctrctctcgggggccctgaccctgaccgagacctgggcgggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccagttctcayaccctccagtggatgattggytgcgacctggkgtccgacggwcgcctcmtccgcgggtatgaacagtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcgcggacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggaagcagtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaatggaagacatgagaactttcc

SEQ ID NO: 206 - DNA, 549 bp, Homo sapiens
aacatatagtaacatagtgtggtactttgtcttgaggagatgtcctggactcacacggaaacttagggctacggaatgaagacgccaaggatggtggtcatggcrccccgaaccctcttcctgctrctctcgggggccctgaccctgaccgagacctgggcgggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagraagaagagctca

SEQ ID NO: 207 - DNA, 357 bp, Homo sapiens
gccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagraagaagagctca

SEQ ID NO: 208 - DNA, 1216 bp, Homo sapiens
aacatatagtaacatagtgtggtactttgtcttgaggagatgtcctggactcacacggaaacttagggctacggaatgaagacgccaaggatggtggtcatggcrccccgaaccctcttcctgctrctctcgggggccctgaccctgaccgagacctgggcgggctcccactccatgaggtatttcagcgccgccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccaacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggaagcagtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaatggaagacatgagaactttcc

SEQ ID NO: 209 - DNA, 1024 bp, Homo sapiens
gccgtgtcccggcccggccgcggggagccccgcttcatcgccatgggctacgtggacgacwcgcarttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggccaacccccccaagacacaygtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacayrtgccatgtgcagcatgaggggctgccrgagcccctcatgctgagatggaagcagtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaagaaccctgactyctctttstgcagagaccagcccacccctgtgcccaccatgaccctcttcctcatgctgaactgcattccttccccaatcacctttcctgttccagaaaaggggctgggatgtctccgtctctgtctcaaatttgtggtscactgagctataacttacttctgtattaaaattagaatctgagtrtaaatttastttttcaaattatttccaagagagattgatgggttaattaaaggagaagattcctgaaatttgagagacaaaataaatggaagacatgagaactttcc

SEQ ID NO: 210 - DNA, 2024 bp, Homo sapiens
  misc_feature (1)...(2024): n = A,T,C or G, or insertion/deletion polymorphism (see Tables 1-2)
tgggaaggyacctgagggtggggtcaagggaggccccaaaacagtctacacagcaggagggatggctggggctcttgagctataagtggcacctcagggccctgacgggcgtctygccatgctgctcctgggcctgctgctgctgctgcccctgctggctggcrcccgcctgctgtggaactggtggaagctccggagcctccacctccygcctcttgcccygggcttcttgcacytgctgcagcccgacctcccmatctatctgcttggcctgactcagaaattcgggcccatctacaggctccwccttgggctgcaagacaagctggtgtctargaactacccsgacctktccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcawctgttacctcaccttcggagacaagatcaaggasgacaacttaatgcctgcctattacaaatgtatccaggaggtgttaaaaacctggagccactggtccatccaaattgtggacrtgattccctttctcaggttcttccccaatccaggtctccggaggytgaagcaggccatagagaagagggaycacatcgwggagawgcagctgaggcagcacaaggagagcctsgtggcaggccagtggagggacatgatggactacatgctccaaggggtggcgcagcygascatggaagagggctcyggacagctcctggaagggcacktgcacatggctgcagtggacctcctgatcggtggcactgagaccacagcaaacaccctctcctgggccgtggtttttttgcttcaccaccctgagattcagcagcgactgraggaggagctagaccacgaactgggccctggtgcctccagctcccgggtcccctacaaggaccgtgcacggctgcccttgctcaatgccaccatcgccgaggtgctgcgcctgnggcccgttgtgcccttagccttgccccaccgcaccacacggcccagcagcatctcyggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcytgggcgagccgctggcgcgcctggagctcttcgtggtgctgacccgactgctgcaggccttcacgctgctgycctccggggacgccctgccctccctgcagcccctgccccactgcagtgtcatcctcaagatgcagcctttccaagtgcggctgcagccccgggggatgggggcccacagcccrggccagarccagtgatggggcaggacygatgccagccgggtacctcagtttctcctttattgctccygtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccyttccccttaaggaggtagctcccagcactcaaccaacctccccgcagagctcccttcctgaccctccgctgcagaggattgaggcttaattctgagctggncctttccagccaataaatcaactccagctccctc

SEQ ID NO: 211 - DNA, 2114 bp, Homo sapiens
  misc_feature (1)...(2114): n = A,T,C or G, or insertion/deletion polymorphism (see Tables 1-2)
tgggaaggyacctgagggtggggtcaagggaggccccaaaacagtctacacagcaggagggatggctggggctcttgagctataagtggcacctcagggccctgacgggcgtctygccatgctgctcctgggcctgctgctgctgctgcccctgctggctggcrcccgcctgctgtggaactggtggaagctccggagcctccacctccygcctcttgcccygggcttcttgcacytgctgcagcccgacctcccmatctatctgcttggcctgactcagaaattcgggcccatctacaggctccwccttgggctgcaagatgtggtggtgctgaactccaagaggaccattgaggaagccatggtcaaaaagtgggcagactttgctggcagacctgagccacttacctacaagctggtgtctargaactacccsgacctktccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcawctgttacctcaccttcggagacaagatcaaggasgacaacttaatgcctgcctattacaaatgtatccaggaggtgttaaaaacctggagccactggtccatccaaattgtggacrtgattccctttctcaggttcttccccaatccaggtctccggaggytgaagcaggccatagagaagagggaycacatcgwggagawgcagctgaggcagcacaaggagagcctsgtggcaggccagtggagggacatgatggactacatgctccaaggggtggcgcagcygascatggaagagggctcyggacagctcctggaagggcacktgcacatggctgcagtggacctcctgatcggtggcactgagaccacagcaaacaccctctcctgggccgtggtttttttgcttcaccaccctgagattcagcagcgactgraggaggagctagaccacgaactgggccctggtgcctccagctcccgggtcccctacaaggaccgtgcacggctgcccttgctcaatgccaccatcgccgaggtgctgcgcctgnggcccgttgtgcccttagccttgccccaccgcaccacacggcccagcagcatctcyggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcytgggcgagccgctggcgcgcctggagctcttcgtggtgctgacccgactgctgcaggccttcacgctgctgycctccggggacgccctgccctccctgcagcccctgccccactgcagtgtcatcctcaagatgcagcctttccaagtgcggctgcagccccgggggatgggggcccacagcccrggccagarccagtgatggggcaggacygatgccagccgggtacctcagtttctcctttattgctccygtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccyttccccttaaggaggtagctcccagcactcaaccaacctccccgcagagctcccttcctgaccctccgctgcagaggattgaggcttaattctgagctggncctttccagccaataaatcaactccagctccctc

SEQ ID NO: 212 - DNA, 2052 bp, Homo sapiens
cacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgt

SEQ ID NO: 213 - DNA, 1761 bp, Homo sapiens
ctcccatccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgt

SEQ ID NO: 214 - DNA, 3974 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggmrgaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggtgagatggtgcagcagggctgcagggggctgggtggggtcatgtccactgaagaactgtactatggggacagaaaaccagaaatgtggagactgaactggtatcccagagagtgcacgaccctgggcatctgggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgggggggatttgttccaaagaatggatgagtccactggccaatgtggggtagaggggtagagaagaccacataggaagagactccactggggatggaatgttcccctcccttgtgtaggctgagtcactggagatgagggggaggcaactgtcccacagacaagacagtaggaggtgggggtcaagagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgg

SEQ ID NO: 215 - DNA, 3801 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggmrgaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggtgagatggtgcagcagggctgcagggggctgggtggggtcatgtccactgaagaactgtactatggggacagaaaaccagaaatgtggagactgaactggtatcccagagagtgcacgaccctgggcatctgggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgggggggatttgttccaaagaatggatgagtccactggccaatgtggggtagaggggtagagaagaccacataggaagagactccactggggatggaatgttcccctcccttgtgtaggctgagtcactggagatgagggggaggcaactgtcccacagacaagacagtaggaggtgggggtcaagagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgg

SEQ ID NO: 216 - DNA, 2888 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgt

SEQ ID NO: 217 - DNA, 2482 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtgt

SEQ ID NO: 218 - DNA, 3514 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggmrgaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttcagatagtcaccaccaccccggccatcagtggagatttcccggaaaacagtgagcatggagtgccggactctgtcagccagagctgggacgtcatctggtgtcagcccttccgtgg

SEQ ID NO: 219 - DNA, 2264 bp, Homo sapiens
cttgaagcctcccaggagaaagaagccaggtgggaatggagagagagaggaaggcaacctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggmrgaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggtgagatggtgcagcagggctgcagggggctgggtggggtcatgtccactgaagaactgtactatggggacagaaaaccagaaatgtggagactgaactggtatcccagagagtgcacgaccctgggcatctgggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgggggggatttgttccaaagaatggatgagtccactggccaatgtggggtagaggggtagagaagaccacataggaagagactccactggggatggaatgttcccctcccttgtgtaggctgagtcactggagatgagggggaggcaactgtcccacagacaagacagtaggaggtgggggtcaagagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgg

SEQ ID NO: 220 - DNA, 3950 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggmrgaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggtgagatggtgcagcagggctgcagggggctgggtggggtcatgtccactgaagaactgtactatggggacagaaaaccagaaatgtggagactgaactggtatcccagagagtgcacgaccctgggcatctgggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgggggggatttgttccaaagaatggatgagtccactggccaatgtggggtagaggggtagagaagaccacataggaagagactccactggggatggaatgttcccctcccttgtgtaggctgagtcactggagatgagggggaggcaactgtcccacagacaagacagtaggaggtgggggtcaagagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgg

SEQ ID NO: 221 - DNA, 2207 bp, Homo sapiens
cctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggmrgaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggtgagatggtgcagcagggctgcagggggctgggtggggtcatgtccactgaagaactgtactatggggacagaaaaccagaaatgtggagactgaactggtatcccagagagtgcacgaccctgggcatctgggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgggggggatttgttccaaagaatggatgagtccactggccaatgtggggtagaggggtagagaagaccacataggaagagactccactggggatggaatgttcccctcccttgtgtaggctgagtcactggagatgagggggaggcaactgtcccacagacaagacagtaggaggtgggggtcaagagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgg

SEQ ID NO: 222 - DNA, 2577 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaagcctagtttctttgaggccccaggccctcttttaactacctttgaataggtgttatccctgt

SEQ ID NO: 223 - DNA, 1337 bp, Homo sapiens
attttccgkcaagttttagccaatgagttgatttggagccatacgctccaaagtccaatagcaatccggacattctctaraagaggaagcgaaggaaagaaaggggcttatagtgggcgaggtctataggtagtcccgagcaaattgcttatggctttggttatgactgacaactactcagacgaataaagccctccttggccaggsgacagsgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctggkatcagcagagagaaggttgtcccgctttatgggcgagggagccagaagccccaggatcccagattraaaactccaccccgcccccagggccagagaccagctccrgagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccrgcctccagctggcaggattccctcttcctgtttctcgccatcttcttctttttttggctgctcagtatttgagctatgtctgcttcctgcccacctccagccagagaagaatcagtattgagggggaaggaggatggattgagagaatgtctttctcctctcctaagtctttgctttccctgatttcttgatttsatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatatatt

SEQ ID NO: 224 - DNA, 1516 bp, Homo sapiens
attttccgkcaagttttagccaatgagttgatttggagccatacgctccaaagtccaatagcaatccggacattctctaraagaggaagcgaaggaaagaaaggggcttatagtgggcgaggtctataggtagtcccgagcaaattgcttatggctttggttatgactgacaactactcagacgaataaagccctccttggccaggsgacagsgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctggkatcagcagagagaaggttgtcccgctttatgggcgagggagccagaagccccaggatcccagattraaaactccaccccgcccccagggccagagaccagctccrgagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccrgcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttsatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatatattga

SEQ ID NO: 225 - DNA, 1511 bp, Homo sapiens
attttccgkcaagttttagccaatgagttgatttggagccatacgctccaaagtccaatagcaatccggacattctctaraagaggaagcgaaggaaagaaaggggcttatagtgggcgaggtctataggtagtcccgagcaaattgcttatggctttggttatgactgacaactactcagacgaataaagccctccttggccaggsgacagsgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactggtgagaatccccagtggctggagacacggccagaacggcaagagtgtccagtatgtaaagctggkatcagcagagagaaggttgtcccgctttatgggcgagggagccagaagccccaggatcccagattraaaactccaccccgcccccagggccagagaccagctccrgagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccrgcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttsatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatatattga

SEQ ID NO: 226 - DNA, 1081 bp, Homo sapiens
cacaattgctctacagctcagagcagcaactgctgagsctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagaygagsagttctaygtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaycctcatytgtcttgtggacaacatctttcctcctgtggtcaacatcacmtggctgagcaatgggcaskcagtcacagaaggtgtttctgagaccagcttcctctccaagagtgatcattccttcttcaagatcagttacctcaccytcctcccttctkctgakgagakttatgactgcaaggtggagcactggggcctggacsagcctcttctgaaacactgggagcctgagattccagcccctatgtcagagctcacagagactttggtctgcgccctggggttgtctgtgggcctcrtgggcattgtggtgggcactgtcttcatcatccaaggcctgcgttcagttgrtgcttccagacaccaagggctcttatgaatcycatcctgaaaggaaggtgcatcaccatctacaggagaagaagaatggacttgctaaatgacctagcaytattytctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgrgtaagc

SEQ ID NO: 227 - DNA, 841 bp, Homo sapiens
cacaattgctctacagctcagagcagcaactgctgagsctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagaygagsagttctaygtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaycctcatytgtcttgtggacaacatctttcctcctgtggtcaacatcacmtggctgagcaatgggcaskcagtcacagaaggtgtttctgagaccagcttcctctccaagagtgatcattccttcttcaagatcagttacctcaccytcctcccttctkctgakgagakttatgactgcaaggtggagcactggggcctggacsagcctcttctgaaacactgggagcctgagattccagcccctatgtcagagctcacagagactttggtctgcgccctggggttgtctgtgggcctcrtgggcattgtggtgggcactgtcttcatcatccaaggcctgcgttcagttgrtgcttccagacaccaagggctcttatgaatcycatcctgaaaggaag

SEQ ID NO: 228 - DNA, 1421 bp, Homo sapiens
cacaattgctctacagctcagagcagcaactgctgagsctgccttgggaagaagatgatcctaaacaaagctctgctgctgggggccctcgccctgactgccgtgatgagcccctgtggaggtgaagacattgtggctgaccatgttgcctcctatggtgtgaacttctaccagtctcacggtccctctggccagtacacccatgaatttgatggagaygagsagttctaygtggacctggagacgaaagagactgtctggcagttgcctatgtttagcaaatttataagttttgacccgcagagtgcactgagaaatatggctgtgggaaaacacaccttggaattcatgatgagacagtccaactctaccgctgccaccaatgaggttcctgaggtcacagtgttttccaagtttcctgtgacgctgggtcagcccaacaycctcatytgtcttgtggacaacatctttcctcctgtggtcaacatcacmtggctgagcaatgggcaskcagtcacagaaggtgtttctgagaccagcttcctctccaagagtgatcattccttcttcaagatcagttacctcaccytcctcccttctkctgakgagakttatgactgcaaggtggagcactggggcctggacsagcctcttctgaaacactgggagcctgagattccagcccctatgtcagagctcacagagactttggtctgcgccctggggttgtctgtgggcctcrtgggcattgtggtgggcactgtcttcatcatccaaggcctgcgttcagttgrtgcttccagacaccaagggctcttatgagtgcatcaccatctacaggagaagaagaatggacttgctaaatgacctagcaytattytctggcctgatttatcatatcccttttctcctccaaatgtttcttctctcacctcttctctgggacttaaggtgctatattccctcagagctcacaaatgcctttcaattctttccctgacctcctttcctgaatttttttattttctcaaatgttacctactaagggatgcctgrgtaagccactcagctacctaattcctcaatgacctttatctaaaatctccatggaagcaataaattcccttttgatgcctctattgaatttttcccatctttcatctcagggctgactgagagcataacttagaatgggygactcttatgttttaggccaatttcatrtcattccccagatcatatttcawgtccagtaacacaggagcaaccaagtacagtgtatcctgataatttgttgatttcttaactggtgttaatatttctttcttccttttgttcctacccttggccactgccasccacccctcaattcaggtaccaacgaaccctctgcccttggctcagaatggttatagcagaaa

SEQ ID NO: 229 - DNA, 2371 bp, Homo sapiens
gtcggggccatggggctgggcccggtcttyctgcttctggctggcatcttcccttttgcacctccgggagctgctgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaratgtcctgggagctragacctgggacacagagaccgaggacttgacagagaatgggcaagacctcaggaggaccctgactcatatcaaggaccagaaaggaggcttgcattccctccaggagattagggtctgtgagatscatgaagacagcagcaccaggggctcccggcatttctactacratggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcayrgcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaat

SEQ ID NO: 230 - DNA, 1523 bp, Homo sapiens
gtctccagcccactggaattttctcttccaagcgtggccccgccctctccgctcgtgattggccctaagttccgggccccagtttcattggatgagcggtcgggggaccgggccaggtgactaagtttccgcgrcgccttctccccggccactgcttgagccgctgagagggtggcgacgtcggggccatggggctgggcccggtcttyctgcttctggctggcatcttcccttttgcacctccgggagctgctgctgagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattttctaygtcygttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattg

SEQ ID NO: 231 - DNA, 2292 bp, Homo sapiens
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaratgtcctgggagctragacctgggacacagagaccgaggacttgacagagaatgggcaagacctcaggaggaccctgactcatatcaaggaccagaaaggaggcttgcattccctccaggagattagggtctgtgagatscatgaagacagcagcaccaggggctcccggcatttctactacratggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcayrgcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaat

SEQ ID NO: 232 - DNA, 1724 bp, Homo sapiens
ggctagtcaagtgaaacagtgggagtgaagaagaaacaaagacatctataactggttgtgatcaattagttgtamacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcgrcgccttctccccggccactgcttgagccgctgagagggtggcgacgtcggggccatggggctgggcccggtcttyctgcttctggctggcatcttcccttttgcacctccgggagctgctgctgagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattttctaygtcygttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattg

SEQ ID NO: 233 - DNA, 1413 bp, Homo sapiens
ggcggagcggagccmcgccctgggttatgtaagcgaccgcgctgggccgtttctctttcttttccggaccctgcagtggcgcctraagtctgagagagggaagtcgcctctgtgctsgtgagtgcatggggtataaggcaaagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattttctaygtcygttgttgtaagaagaaaacatcagctgcagagggtccaggtgagaaaactcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattg

SEQ ID NO: 234 - DNA, 1731 bp, Homo sapiens
ggctagtcaagtgaaacagtgggagtgaagaagaaacaaagacatctataactggttgtgatcaattagttgtamacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcgrcgccttctccccggccactgcttgagccgctgagagggtggcgacgtcggggccatggggctgggcccggtcttyctgcttctggctggcatcttcccttttgcacctccgggagctgctgctgagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattttctaygtcygttgttgtaagaagaaaacatcagctgcagagggtccaggtgagaaaactcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattg

SEQ ID NO: 235 - DNA, 2192 bp, Homo sapiens
ccagtggacactagctgttccatccaattgctgtcctggggccttgtcatgctactcttccactttgaacccaagcccacaccgttcgttgctcccctctgggatactgaccccactataaacttctctrgggctacaaccttcctacccyttgtgcctcatgaccaccccctcccttgtccccgccatgcccatgatgagtctcttctcraggcagctcsccttgcctccatctcaccctcagcctatgcaccacagccacactggacatgggtccctctgagcctgagtcccttcccattcccacyatcycctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccycaggaaggttgggacagcagacctgtgtgttaaacatcaatgtgaagttayttccaggaagaagtttcayctrtgatttcctcttccccagagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggrggagggccagggaggcrtaccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattttctaygtcygttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattg

SEQ ID NO: 236 - DNA, 1378 bp, Homo sapiens
atgtttgtctttttgtttctggcttatttcacttataatatttttgaggttcggtgggcacagtggctcacgcctggatttccagcactttgggaggctgaagcagagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattttctaygtcygttgttgtaagaagaaaacatcagctgcagagggtccaggtgagaaaactcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattg

SEQ ID NO: 237 - DNA, 2362 bp, Homo sapiens
atggggctgggcccggtcttyctgcttctggctggcatcttcccttttgcacctccgggagctgctgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaratgtcctgggagctragacctgggacacagagaccgaggacttgacagagaatgggcaagacctcaggaggaccctgactcatatcaaggaccagaaaggaggcttgcattccctccaggagattagggtctgtgagatscatgaagacagcagcaccaggggctcccggcatttctactacratggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcayrgcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaat

SEQ ID NO: 238 - DNA, 1365 bp, Homo sapiens
cactgcttgagccgctgagagggtggcgacgtcggggccatggggctgggcccggtcttcctgcttctggctggcatcttcccttttgcacctccgggagctgctgctgagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaacagtgccccccatggtgaatgtcacccgcagcgaggcctcagagggcaacattaccgtgacatgcagggcttctggcttctatcccyggaatatcayactgasctggcgtcaggatggggtatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctgggaaagtgctggtgcttcagagtcattggcagacattccatgtttctgctgttgctgctgctgctatttttgttattattattttctatgtcygttyttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcrcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatatt

SEQ ID NO: 239 - DNA, 2539 bp, Homo sapiens
ggaaaccagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtcccyatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctmtttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctg

SEQ ID NO: 240 - DNA, 1715 bp, Homo sapiens
gggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgc

SEQ ID NO: 241 - DNA, 5816 bp, Homo sapiens
  misc_feature (1)...(5816): n = A,T,C or G, or insertion/deletion polymorphism (see Tables 1-2)
agacgtgaggcttgcagcaggcygaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagwttcctgacccctgccagaacgcccagctctgccaaaatggaggcagctgccaagccctgcttccygctcccctagggctccccagctctccctctccattgacacccagcttcttgtgcacttgcctccctggcttcactggygagagatgccaggccnagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacrtacccccagatccagtgccactgcccaccgggcttygagggccatgcctgtgaacgtgatgtcaacgagtgcttccaggacccaggacyctgccccaaaggcacctcctgccataacaccctrggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccrgrctgtgaggtgaatccagacaactgtgtcagccaccartgtcagaatgggggcacttgccaggatgggctggacacctacacctgcctctgcccagaaacctggacaggattctccggcacccgatgtgaggaggatatcgatgagtgcagaagctctccctgtgccaatggtgggcagtgccaggaccagcctggagccttccactgcaagtgtctcccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggctttcgatgctcctgccctcacagctctccagggccccggtgtcagaaacccggagccaaggggtgtgagggcagaagtggagatggggcctgcgatgctggctgcagtggcccgggaggaaactgggatgraggggactgctctctrggagtcccagacccctggaagsgctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacrcagcccctgggcaaggagaccgactccctcagtgctgggtttgtggtggtmatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggtgaaagggctggggcaagaatggtctggaggtgatggaagsgatsaaagggcaaatcaaccttcactgatccttgctgttacccaaaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 242 - DNA, 6747 bp, Homo sapiens
  misc_feature (1)...(6747): n = A,T,C or G, or insertion/deletion polymorphism (see Tables 1-2)
agacgtgaggcttgcagcaggcygaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagwttcctgacccctgccagaacgcccagctctgccaaaatggaggcagctgccaagccctgcttccygctcccctagggctccccagctctccctctccattgacacccagcttcttgtgcacttgcctccctggcttcactggygagagatgccaggccnagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacrtacccccagatccagtgccactgcccaccgggcttygagggccatgcctgtgaacgtgatgtcaacgagtgcttccaggacccaggacyctgccccaaaggcacctcctgccataacaccctrggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccrgrctgtgaggtgaatccagacaactgtgtcagccaccartgtcagaatgggggcacttgccaggatgggctggacacctacacctgcctctgcccagaaacctggacaggctgggactgctccgaagatgtggatgagtgtgagrcccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcrgattgccatgacctgctcaacrgcttccagtgcatctgyctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccsttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactgkctacaccggaggcagctgccagactytgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacrgggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagaccyctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatgraggggactgctctctrggagtcccagacccctggaagsgctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacrcagcccctgggcaaggagaccgactccctcagtgctgggtttgtggtggtmatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacrtcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttacc

SEQ ID NO: 243 - DNA, 1790 bp, Homo sapiens
acacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggca

SEQ ID NO: 244 - DNA, 2324 bp, Homo sapiens
ctcttytagagaatgtccggattgctattggactttggagcgtatggctccaaatcaactcattggctaaaacttgmcggaaaatggtggttaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtcccyatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctmtttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctg

SEQ ID NO: 245 - DNA, 2350 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcaggccttccccgacaccgggccttgcgcacagcccccatccagccccgtgtctgggccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgagctccccccctccccgctctccctccgcccgccccccccgccccccccccccgccgctgccttcatctctccatctctgcgctgctgccgctgcgccatccagcacccagactccagcaccggccgaggacccccactccggctgcagggaccctgtcccagcgagaccgcaggcatgtcatccgaaaagtcaggactcccagactcagtccctcacacttctccccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgc

SEQ ID NO: 246 - DNA, 2835 bp, Homo sapiens
atgagaagttagcagttgcgtaaagaaggactggggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaagraagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtcccyatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctmtttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctg

SEQ ID NO: 247 - DNA, 3064 bp, Homo sapiens
acacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggg

SEQ ID NO: 248 - DNA, 1311 bp, Homo sapiens
acacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggatcccactgtcaccccrgc

SEQ ID NO: 249 - DNA, 3765 bp, Homo sapiens
acacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggg

SEQ ID NO: 250 - DNA, 2523 bp, Homo sapiens
ctcttytagagaatgtccggattgctattggactttggagcgtatggctccaaatcaactcattggctaaaacttgmcggaaaatggtgagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtcccyatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctmtttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctg

SEQ ID NO: 251 - DNA, 4386 bp, Homo sapiens
tctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgaacacaggccggacagaagcttggaaggtcctgtctccccagggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctctt

SEQ ID NO: 252 - DNA, 4312 bp, Homo sapiens
tctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttg

SEQ ID NO: 253 - DNA, 2007 bp, Homo sapiens
gcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgaacacaggccggacagaagcttggaaggtcctgtctccccagggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctctt

SEQ ID NO: 254 - DNA, 4226 bp, Homo sapiens
tctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttg

SEQ ID NO: 255 - DNA, 2477 bp, Homo sapiens
gagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 256 - DNA, 1858 bp, Homo sapiens
agcgttcgggggacttgttctctaggtccaggatcttcctaatgcatcgcctcagccatgaacaacgcggagttctttaatacccgtgagcagcagcccaggccccttgaagagtgcagactcccacctggcctgggmgtctggctccgcagcagracacgaagtttgcattccccaaggggcggccagggggcggaccagggaaaggtagtcctctgcattttgccgtgtgctggtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgc

SEQ ID NO: 257 - DNA, 1786 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 258 - DNA, 7922 bp, Homo sapiens
  misc_feature (1)...(7922): n = A,T,C or G, or insertion/deletion polymorphism (see Tables 1-2)
agacgtgaggcttgcagcaggcygaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagwttcctgacccctgccagaacgcccagctctgccaaaatggaggcagctgccaagccctgcttccygctcccctagggctccccagctctccctctccattgacacccagcttcttgtgcacttgcctccctggcttcactggygagagatgccaggccnagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacrtacccccagatccagtgccactgcccaccgggcttygagggccatgcctgtgaacgtgatgtcaacgagtgcttccaggacccaggacyctgccccaaaggcacctcctgccataacaccctrggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccrgrctgtgaggtgaatccagacaactgtgtcagccaccartgtcagaatgggggcacttgccaggatgggctggacacctacacctgcctctgcccagaaacctggacaggctgggactgctccgaagatgtggatgagtgtgagrcccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcrgattgccatgacctgctcaacrgcttccagtgcatctgyctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccsttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactgkctacaccggaggcagctgccagactytgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacrgggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagaccyctgccacagccaaccctgctttcatggagggacctgtgaggccacagcaggatcacccctgggtttcatctgccactgccccaaggcaaggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatgraggggactgctctctrggagtcccagacccctggaagsgctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacrcagcccctgggcaaggagaccgactccctcagtgctgggtttgtggtggtmatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccggtagcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 259 - DNA, 1748 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 260 - DNA, 4475 bp, Homo sapiens
tctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgaacacaggccggacagaagcttggaaggtcctgtctccccagggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctctt

SEQ ID NO: 261 - DNA, 2243 bp, Homo sapiens
ctcttytagagaatgtccggattgctattggactttggagcgtatggctccaaatcaactcattggctaaaacttgmcggaaaatggtggttaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgtcgagaacatgaagatcttgcgtctaatgctgctccacatcaaatacctgtacgggatccgagtggaggtgcgaggggctcaccacttccctccctcgcagccctatgttgttgtctccaaccaccagagctctctcgatctgcttgggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagggtctgggtgtttcctgagggaacgagaaaccacaatggctccatgctgcccttcaaacgtggcgccttccatcttgcagtgcaggcccaggttcccattgtcccyatagtcatgtcctcctaccaagacttctactgcaagaaggagcgtcgcttcacctcgggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctmtttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctggcacmtagcctctcctccagcagcagcacctg

SEQ ID NO: 262 - DNA, 2675 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcaggccttccccgacaccgggccttgcgcacagcccccatccagccccgtgtctgggccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgagctccccccctccccgctctccctccgcccgccccccccgccccccccccccgccgctgccttcatctctccatctctgcgctgctgccgctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgc

SEQ ID NO: 263 - DNA, 7914 bp, Homo sapiens
  misc_feature (1)...(7914): n = A,T,C or G, or insertion/deletion polymorphism (see Tables 1-2)
agacgtgaggcttgcagcaggcygaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagwttcctgacccctgccagaacgcccagctctgccaaaatggaggcagctgccaagccctgcttccygctcccctagggctccccagctctccctctccattgacacccagcttcttgtgcacttgcctccctggcttcactggygagagatgccaggccnagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacrtacccccagatccagtgccactgcccaccgggcttygagggccatgcctgtgaacgtgatgtcaacgagtgcttccaggacccaggacyctgccccaaaggcacctcctgccataacaccctrggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccrgrctgtgaggtgaatccagacaactgtgtcagccaccartgtcagaatgggggcacttgccaggatgggctggacacctacacctgcctctgcccagaaacctggacaggctgggactgctccgaagatgtggatgagtgtgagrcccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcrgattgccatgacctgctcaacrgcttccagtgcatctgyctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccsttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactgkctacaccggaggcagctgccagactytgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacrgggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagaccyctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatgraggggactgctctctrggagtcccagacccctggaagsgctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacrcagcccctgggcaaggagaccgactccctcagtgctgggtttgtggtggtmatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 264 - DNA, 1889 bp, Homo sapiens
gctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 265 - DNA, 7918 bp, Homo sapiens
  misc_feature (1)...(7918): n = A,T,C or G, or insertion/deletion polymorphism (see Tables 1-2)
agacgtgaggcttgcagcaggcygaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagwttcctgacccctgccagaacgcccagctctgccaaaatggaggcagctgccaagccctgcttccygctcccctagggctccccagctctccctctccattgacacccagcttcttgtgcacttgcctccctggcttcactggygagagatgccaggccnagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacrtacccccagatccagtgccactgcccaccgggcttygagggccatgcctgtgaacgtgatgtcaacgagtgcttccaggacccaggacyctgccccaaaggcacctcctgccataacaccctrggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccrgrctgtgaggtgaatccagacaactgtgtcagccaccartgtcagaatgggggcacttgccaggatgggctggacacctacacctgcctctgcccagaaacctggacaggctgggactgctccgaagatgtggatgagtgtgagrcccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcrgattgccatgacctgctcaacrgcttccagtgcatctgyctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccsttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactgkctacaccggaggcagctgccagactytgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacrgggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagaccyctgccacagccaaccctgctttcatggagggacctgtgaggccacagcaggatcacccctgggtttcatctgccactgccccaaggcaaggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatgraggggactgctctctrggagtcccagacccctggaagsgctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacrcagcccctgggcaaggagaccgactccctcagtgctgggtttgtggtggtmatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggaattggggagaagaatgggaaaaaagatgggagtgactgcataatgtcagcattttgtgcttttggctcagcatttggattggatggaggattttcatcctgaaaccagccctccgtcgccaccgaccatggaataattgtcttccacgaaactcttccctggtgccaaaaagggttttatgtatatatttgagagctccacatccctggatctgaatcctccacttcccactggaaccatgcccctcccagtcccgtttctcccctctaggggatggaggctgagagaccccaggaagaagaggatggtgagcagggcccccctcaggatgaggaaggctggccccctccaaactccaccactcggccttggcgatctgctcctccatcccctcctcctccagggacccgccacacagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctc

SEQ ID NO: 266 - DNA, 4658 bp, Homo sapiens
acacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgaacacaggccggacagaagcttggaaggtcctgtctccccagggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctctt

SEQ ID NO: 267 - DNA, 1929 bp, Homo sapiens
cgccccccccccccgccgctgccttcatctctccatctctgcgctgctgccgctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgc

SEQ ID NO: 268 - DNA, 4622 bp, Homo sapiens
acacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgctgaagtgtaagggggcccccaagaaaccaccccagcrgctggaatgraaactgaacacaggccggacagaagcttggaaggtcctgtctccccagggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctctt

SEQ ID NO: 269 - DNA, 1966 bp, Homo sapiens
ctccccccctccccgctctccctccgcccgccccccccgccccccccccccgccgctgccttcatctctccatctctgcgctgctgccgctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgc

SEQ ID NO: 270 - DNA, 6321 bp, Homo sapiens
  misc_feature (1)...(6321): n = A,T,C or G, or insertion/deletion polymorphism (see Tables 1-2)
gtgagagacatcacctccgactccctcagcctctcctggacagtccccgagggccagtttgaccatttcttggtccagtwtaagaatggggangggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagcygctcctgggggagctnacagtgacaggatcctcccctgactcgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtanggcctccacgaggggcggcgngtgggcccggtgtccaccgtgrgcgtgactgccccacaagaggatgtggacragacccccagccctacagaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctccacgaggggcngcgcctrggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcrcgtgggccccatctctgtcattggggtgacggaggaagagacccccagccccacggaactcagcactgaggcccsggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcrgggagctgaccgtgacagatgccacccctgactccctcagcctgtcctggatggtcccygagggccagtttgaccacttcctggtccagtacaggaatggggatgggcagcccaaggtggtgcggkkgccggggcacgaggacggggtcaccatctcaggcctggagccagaccacaagtacaagatgaacctgtacggcttccacrgtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacargatgcacctgtacggcctccaygaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccayaaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccrtcccccaggkccgcttcgactccttcaccgtgcagtacaaggacagggaygggcagccccaggtggtgsgtgtcagggkcgaggagagcgaggtcaccgtggggggcctrgagcccgggcgcaaatacaagatgcayctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacrgcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggtgggagccaagaaaacggcatgggtgggagttgagagagaacgaggaggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggtgccccggccccactgacccaactcccctccctgggtgattccaggaggtgctgcctctggccctcccggagggtctccacctccctctcccctgacccccccttgtctgtcccacaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccgg

SEQ ID NO: 271 - DNA, 10617 bp, Homo sapiens
  misc_feature (1)...(10617): n = A,T,C or G, or insertion/deletion polymorphism (see Tables 1-2)
cagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagctkctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacrcctgggtgagctgacggtgacagacaggacctccgactccttgctcctgcgctggacggtccccgagggcgagtttgactmcttcgtgatccagtacaaagacagggacgggcagccccaggtggtgcccgtggaaggaccccagcgctcggccgtcatcacctccctggatcctggccgcaagtacaratttgtcctgtatgggtttgttggcaagaagaggcatggtccgctggtggctgaagccaagatcttgcctcagagtgacccaagtccagggactccaccccncctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccrccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcrtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccrggcggtgcgtgttgggggcaaggagagtgaggtcaccgtgggaggcctagagcccgggcacaagtacaagatgcacctgtacggcctccaygaggggcagcgcgtgggcccrgtgtccgccgtgggcgtgacagccccacaacaagaagagacccctccagccactgagtccccgctggagccacgcctaggagagctgacartgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactragggagaatttgactccttcgaaatccagtacrcagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacrgttccygagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagaacccagcatggaggccccggagcccgctgaggagccrctcctgggggagctaacagtgacaggatcctcccctgactcgctgagcctctcctggacygtcccccagggccgcttcgactccttcaccrtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtwtaagaatggggangggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactgcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagaggaagagacccccagccccacagaacccagcatggaggccccggagccccctgaggagcygctcctgggggagctnacagtgacaggatcctcccctgactcgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtanggcctccacgaggggcggcgngtgggcccggtgtccaccgtgrgcgtgactgccccacaagaggatgtggacragacccccagccctacagaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctccacgaggggcngcgcctrggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcrcgtgggccccatctctgtcattggggtgacggaggaagagacccccagccccacggaactcagcactgaggcccsggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcrgggagctgaccgtgacagatgccacccctgactccctcagcctgtcctggatggtcccygagggccagtttgaccacttcctggtccagtacaggaatggggatgggcagcccaaggtggtgcggkkgccggggcacgaggacggggtcaccatctcaggcctggagccagaccacaagtacaagatgaacctgtacggcttccacrgtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacargatgcacctgtacggcctccaygaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccayaaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccrtcccccaggkccgcttcgactccttcaccgtgcagtacaaggacagggaygggcagccccaggtggtgsgtgtcagggkcgaggagagcgaggtcaccgtggggggcctrgagcccgggcgcaaatacaagatgcayctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacrgcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccgg

SEQ ID NO: 272 - DNA, 3086 bp, Homo sapiens
  misc_feature (1)...(3086): n = A,T,C or G, or insertion/deletion polymorphism (see Tables 1-2)
ccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccrctgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccngagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcmtggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggtgggagccaagaaaacggcatgggtgggagttgagagagaacgaggaggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccggct

SEQ ID NO: 273 - DNA, 13394 bp, Homo sapiens
  misc_feature (1)...(13394): n = A,T,C or G, or insertion/deletion polymorphism (see Tables 1-2)
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatrctgagatccctccctcttccccaccctcagcctcggggtcctgcccagatgactgcaatgatcagggtcgctgtgtccgtggtcgttgcrtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacnctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccnctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggayggctactctggcgaggattgcggtgtgaggcagtgcccgaatgactgcagccagcacggcgtgtgccaggacggtgtgtgcatctgttgggaaggctacgtgrgtgaggactgcagcatccgcacctgcccctccaactgccacgggaggggccgctgtgaggaagggcgctgcctgtgcgacccaggctacaccggccctacctgtgccacccrcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagctkctgtcagggccaacacagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacrcctgggtgagctgacggtgacagacaggacctccgactccttgctcctgcgctggacggtccccgagggcgagtttgactmcttcgtgatccagtacaaagacagggacgggcagccccaggtggtgcccgtggaaggaccccagcgctcggccgtcatcacctccctggatcctggccgcaagtacaratttgtcctgtatgggtttgttggcaagaagaggcatggtccgctggtggctgaagccaagatcttgcctcagagtgacccaagtccagggactccaccccncctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccrccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcrtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccrggcggtgcgtgttgggggcaaggagagtgaggtcaccgtgggaggcctagagcccgggcacaagtacaagatgcacctgtacggcctccaygaggggcagcgcgtgggcccrgtgtccgccgtgggcgtgacagccccacaacaagaagagacccctccagccactgagtccccgctggagccacgcctaggagagctgacartgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactragggagaatttgactccttcgaaatccagtacrcagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacrgttccygagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccrctcctgggggagctaacagtgacaggatcctcccctgactcgctgagcctctcctggacygtcccccagggccgcttcgactccttcaccrtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtwtaagaatggggangggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactgcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagaggaagagacccccagccccacagaacccagcatggaggccccggagccccctgaggagcygctcctgggggagctnacagtgacaggatcctcccctgactcgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtanggcctccacgaggggcggcgngtgggcccggtgtccaccgtgrgcgtgactgccccacaagaggatgtggacragacccccagccctacagaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctccacgaggggcngcgcctrggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcrcgtgggccccatctctgtcattggggtgacggaggaagagacccccagccccacggaactcagcactgaggcccsggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcrgggagctgaccgtgacagatgccacccctgactccctcagcctgtcctggatggtcccygagggccagtttgaccacttcctggtccagtacaggaatggggatgggcagcccaaggtggtgcggkkgccggggcacgaggacggggtcaccatctcaggcctggagccagaccacaagtacaagatgaacctgtacggcttccacrgtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacargatgcacctgtacggcctccaygaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccayaaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccrtcccccaggkccgcttcgactccttcaccgtgcagtacaaggacagggaygggcagccccaggtggtgsgtgtcagggkcgaggagagcgaggtcaccgtggggggcctrgagcccgggcgcaaatacaagatgcayctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacrgcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggtgccccggccccactgacccaactcccctccctgggtgattccaggaggtgctgcctctggccctcccggagggtctccacctccctctcccctgacccccccttgtctgtcccacaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccgg

SEQ ID NO: 274 - DNA, 13270 bp, Homo sapiens
  misc_feature (1)...(13270): n = A,T,C or G, or insertion/deletion polymorphism (see Tables 1-2)
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatrctgagatccctccctcttccccaccctcagcctcggggtcctgcccagatgactgcaatgatcagggtcgctgtgtccgtggtcgttgcrtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacnctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccnctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggayggctactctggcgaggattgcggtgtgaggcagtgcccgaatgactgcagccagcacggcgtgtgccaggacggtgtgtgcatctgttgggaaggctacgtgrgtgaggactgcagcatccgcacctgcccctccaactgccacgggaggggccgctgtgaggaagggcgctgcctgtgcgacccaggctacaccggccctacctgtgccacccrcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagctkctgtcagggccaacacagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacrcctgggtgagctgacggtgacagacaggacctccgactccttgctcctgcgctggacggtccccgagggcgagtttgactmcttcgtgatccagtacaaagacagggacgggcagccccaggtggtgcccgtggaaggaccccagcgctcggccgtcatcacctccctggatcctggccgcaagtacaratttgtcctgtatgggtttgttggcaagaagaggcatggtccgctggtggctgaagccaagatcttgcctcagagtgacccaagtccagggactccaccccncctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccrccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcrtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccrggcggtgcgtgttgggggcaaggagagtgaggtcaccgtgggaggcctagagcccgggcacaagtacaagatgcacctgtacggcctccaygaggggcagcgcgtgggcccrgtgtccgccgtgggcgtgacagccccacaacaagaagagacccctccagccactgagtccccgctggagccacgcctaggagagctgacartgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactragggagaatttgactccttcgaaatccagtacrcagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacrgttccygagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagaacccagcatggaggccccggagcccgctgaggagccrctcctgggggagctaacagtgacaggatcctcccctgactcgctgagcctctcctggacygtcccccagggccgcttcgactccttcaccrtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtwtaagaatggggangggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactgcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagaggaagagacccccagccccacagaacccagcatggaggccccggagccccctgaggagcygctcctgggggagctnacagtgacaggatcctcccctgactcgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtanggcctccacgaggggcggcgngtgggcccggtgtccaccgtgrgcgtgactgccccacaagaggatgtggacragacccccagccctacagaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctccacgaggggcngcgcctrggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcrcgtgggccccatctctgtcattggggtgacggaggaagagacccccagccccacggaactcagcactgaggcccsggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcrgggagctgaccgtgacagatgccacccctgactccctcagcctgtcctggatggtcccygagggccagtttgaccacttcctggtccagtacaggaatggggatgggcagcccaaggtggtgcggkkgccggggcacgaggacggggtcaccatctcaggcctggagccagaccacaagtacaagatgaacctgtacggcttccacrgtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacargatgcacctgtacggcctccaygaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccayaaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccrtcccccaggkccgcttcgactccttcaccgtgcagtacaaggacagggaygggcagccccaggtggtgsgtgtcagggkcgaggagagcgaggtcaccgtggggggcctrgagcccgggcgcaaatacaagatgcayctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacrgcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccggct

SEQ ID NO: 275 - DNA, 3127 bp, Homo sapiens
  misc_feature (1)...(3127): n = A,T,C or G, or insertion/deletion polymorphism (see Tables 1-2)
ccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccrctgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccngagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcmtggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccggct

SEQ ID NO: 276 - DNA, 11195 bp, Homo sapiens
  misc_feature (1)...(11195): n = A,T,C or G, or insertion/deletion polymorphism (see Tables 1-2)
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatrctgagatccctccctcttccccaccctcagcctcggggtcctgcccagatgactgcaatgatcagggtcgctgtgtccgtggtcgttgcrtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacnctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccnctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggayggctactctggcgaggattgcggtgtgaggcagtgcccgaatgactgcagccagcacggcgtgtgccaggacggtgtgtgcatctgttgggaaggctacgtgrgtgaggactgcagcatccgcacctgcccctccaactgccacgggaggggccgctgtgaggaagggcgctgcctgtgcgacccaggctacaccggccctacctgtgccacccrcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagtgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagctkctgtcagggccaacacaggaccccagcgctcggccgtcatcacctccctggatcctggccgcaagtacaratttgtcctgtatgggtttgttggcaagaagaggcatggtccgctggtggctgaagccaagatcttgcctcagagtgacccaagtccagggactccaccccncctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccrccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcrtgtggggcccgagtctgtggtggccaagactggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccrggcggtgcgtgttgggggcaaggagagtgaggtcaccgtgggaggcctagagcccgggcacaagtacaagatgcacctgtacggcctccaygaggggcagcgcgtgggcccrgtgtccgccgtgggcgtgacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacgggtgaggggcattccctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgcgcctgagccccacctcggggagttgacagtggaggaggccacgtcacacaccctgcatctctcctggatggtgactragggagaatttgactccttcgaaatccagtacrcagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagaacctcccaccgcaacccccgagccccccatcaagcctcgcctgggggagctgaccgtgacagatgccacccctgactccctcagcctgtcctggacrgttccygagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccrctcctgggggagctaacagtgacaggatcctcccctgactcgctgagcctctcctggacygtcccccagggccgcttcgactccttcaccrtgcagtacaaggacagggacgggcggccccaggtggtgcgtgttgggggcgaggagacccccgaagaggagtcccctgatgctcctcttgcaaagctgcgcctagggcagatgacagtgagagacatcacctccgactccctcagcctctcctggacagtccccgagggccagtttgaccatttcttggtccagtwtaagaatggggangggcagcccaaggcggtgcgggtgccgggacacgaggatggggctgcagaggaagagacccccagccccacagaacccagcatggaggccccggagccccctgaggagcygctcctgggggagctnacagtgacaggatcctcccctgactcgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtanggcctccacgaggggcggcgngtgggcccggtgtccaccgtgrgcgtgactgaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctccacgaggggcngcgcctrggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcrcgtgggccccatctctgtcattggggtgacggaggaagagacccccagccccacggaactcagcactgaggcccsggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagctccagaggatgaagcagagaccacccaagcagtgcccaccacaacccctgagccccccaacaagcctcgcctcrgggagctgaccgtgacagatgccacccctgactccctcagcctgtcctggatggtcccygagggccagtttgaccacttcctggtccagtacaggaatggggatgggcagcccaaggtggtgcggkkgccggggcacgaggacggggtcaccatctcaggcctggagccagaccacaagtacaagatgaacctgtacggcttccacrgtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacargatgcacctgtacggcctccaygaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccayaaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccrtcccccaggkccgcttcgactccttcaccgtgcagtacaaggacagggaygggcagccccaggtggtgsgtgtcagggkcgaggagagcgaggtcaccgtggggggcctrgagcccgggcgcaaatacaagatgcayctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacrgcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccggct

SEQ ID NO: 277 - DNA, 3206 bp, Homo sapiens
  misc_feature (1)...(3206): n = A,T,C or G, or insertion/deletion polymorphism (see Tables 1-2)
ccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccrctgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccngagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcmtggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagakccaggtgccccggccccactgacccaactcccctccctgggtgattccaggaggtgctgcctctggccctcccggagggtctccacctccctctcccctgacccccccttgtctgtcccacaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccgg

SEQ ID NO: 278 - DNA, 6214 bp, Homo sapiens
  misc_feature (1)...(6214): n = A,T,C or G, or insertion/deletion polymorphism (see Tables 1-2)
gccccatgagcgcgccgcggcccgggctggcgtgcgggtgcggctgcggcggccgcgcggcggggccccgggaggcgggtcgctgagcggggcgckcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatncggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccatycaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgngagagtggagttggtcccaactaaagaaaacaacactggttacatcaaygcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatcatatcttgaagagatccagtctgttcgacgccatacaaatagcacaagtgatccccaaarccccaaccctccgttgttggtccactgcagtgctggggtaggaaggactggcgtggtgattttgtcggagatcatgatygcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttccygttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacatta

SEQ ID NO: 279 - DNA, 2983 bp, Homo sapiens
  misc_feature (1)...(2983): n = A,T,C or G, or insertion/deletion polymorphism (see Tables 1-2)
cggggcctccgagtctactggttggcctggcaacgccgcgtgctcttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtgcgctggcgtcaatgctcccttcctcgggccattggagactccgttgctttttaatggcggcagcggctgctgggtgagcagctggaggccggacagtgttcgtcccatncggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccatycaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctaggg

SEQ ID NO: 280 - DNA, 2844 bp, Homo sapiens
  misc_feature (1)...(2844): n = A,T,C or G, or insertion/deletion polymorphism (see Tables 1-2)
gccccatgagcgcgccgcggcccgggctggcgtgcgggtgcggctgcggcggccgcgcggcggggccccgggaggcgggtcgctgagcggggcgckcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatncggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccatycaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctaggg

SEQ ID NO: 281 - DNA, 538 bp, Homo sapiens
gcaggtgggctcacaggagtagcagcagcagactgggcggcagcaggactgtccacagtaggatgggcggcagcaggaggcctcggcgtggtgcagytggcagcaggttgggggtgtgcagctcaccacacagcaggggggcaggcaggtaccctccacacggcagtctgggcggcaccacctgayacgggtgctcacagctccactgctgccctcctggccatagccaatgccaccaccaatgccacagccagttcygcaggagctggtctggcagcagcttggctggcagcagctggtctcacagcagcttggctggcagcaactggagctgcaggtcccactagttgagaagctaggaaatccgcagaagctggtctggcagcagcttggctggcagsagctggtctcacagcagcttkgctggcagcagctggagccgcatgtcccactggtggagcagctgggatatccacagaagctggtctggcagcaggtcatggtgttgggagctgstatgaagtctgggttgcttgga

SEQ ID NO: 282 - DNA, 1591 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacacmgccatgtcccggcccggccgcggggagccccgcttcatctcagtgggctacgtggacgacacccagttcgtgaggttcgacagcgacgccgcgagtccgagagaggagccgcgggcgccrtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggyataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtsgctccgcagatacctggagaacgggaaggacacgctggagcgcgcggaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttgtggagaccagaccagcaggagayagaaccttccagaagtggrcagctgtggtggtgccttctggagaagagcagagatacacatgccatgtacagcatgaggggctgccraagcccctcaccctgagatgggagccrtcttcccagtccaccrtccccatygtgggcattgttgctggcctggctgtcctagcagttgtggtcatcggagctgtggtcgctrctgtgatgtgtaggaggaagagytcaggtggaaaaggagggagctactctcaggctgcgtgcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtccctgttagcataatgtgaggaggtggagagacagcccamccyygtgtccacygtgacccctgttcccatgctgacytgtgtttcctccccagtcatctttcytgttccagagaggtggggctggatgtctccatctctgtctcaactttayrtgcactgagctgcaacttcttacttccctactgaaaataagaatctgaatataaatttgttttctcaaatatttgctatgagaggttgatggattaattaaataagtcaattcctggaatktgagagagcaaataaagacctgagaaccttccagaatctgc

SEQ ID NO: 283 - DNA, 1536 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacacmgccatgtcccggcccggccgcggggagccccgcttcatctcagtgggctacgtggacgacacccagttcgtgaggttcgacagcgacgccgcgagtccgagagaggagccgcgggcgccrtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggyataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtsgctccgcagatacctggagaacgggaaggacacgctggagcgcgcggaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttgtggagaccagaccagcaggagayagaaccttccagaagtggrcagctgtggtggtgccttctggagaagagcagagatacacatgccatgtacagcatgaggggctgccraagcccctcaccctgagatgggagccrtcttcccagtccaccrtccccatygtgggcattgttgctggcctggctgtcctagcagttgtggtcatcggagctgtggtcgctrctgtgatgtgtaggaggaagagytcaggtggaaaaggagggagctactctcaggctgcgtgcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtccctgttagcataatgtgaggaggtggagagacagcccamccyygtgtccacygtgacccctgttcccatgctgacytgtgtttcctccccagtcatctttcytgttccagagaggtggggctggatgtctccatctctgtctcaactttayrtgcactgagctgcaacttcttacttccctaagaggttgatggattaattaaataagtcaattcctggaatktgagagagcaaataaagacctgagaaccttccagaa

SEQ ID NO: 284 - DNA, 1587 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacacmgccatgtcccggcccggccgcggggagccccgcttcatctcagtgggctacgtggacgacacccagttcgtgaggttcgacagcgacgccgcgagtccgagagaggagccgcgggcgccrtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggyataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtsgctccgcagatacctggagaacgggaaggacacgctggagcgcgcggaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttgtggagaccagaccagcaggagayagaaccttccagaagtggrcagctgtggtggtgccttctggagaagagcagagatacacatgccatgtacagcatgaggggctgccraagcccctcaccctgagatgggccrtcttcccagtccaccrtccccatygtgggcattgttgctggcctggctgtcctagcagttgtggtcatcggagctgtggtcgctrctgtgatgygtaggaggaagagctcaggtggaaaaggagggagctgctctcaggctgcgtscagcaacagtgcccagggctctgatgagtctctcatcrcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccacygtgacccctgtccccacactgacctgtgttycctccccgrtcatctttcctgttccagagargtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 285 - DNA, 1703 bp, Homo sapiens
cgagtttcacttcttctcccaacctatgtcgggtccttcttccaggatactcgtgacgcrtccccatttcccactcccattgggtgtcgggtgtctagagaagccaatcagtgtcgccgsggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgmgctcctggaccgcggcggacaccgcggctcagatcacccagcgcaagtgggaggcggcccgtswggcggagcagctgagagcctacctggagggcctgtgcgtggagtsgctccgcagatacctggagaacgggaaggasacgctgsagcgcgcggaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttgtggagaccagaccagcaggagayagaaccttccagaagtggrcagctgtggtggtgccttctggagaagagcagagatacacatgccatgtacagcatgaggggctgccraagcccctcaccctgagatgggagccrtcttcccagtccaccrtccccatygtgggcattgttgctggcctggctgtcctagcagttgtggtcatcggagctgtggtcgctrctgtgatgtgtaggaggaagagytcaggtggaaaaggagggagctactctcaggctgcgtgcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtccctgttagcataatgtgaggaggtggagagacagcccamccyygtgtccacygtgacccctgttcccatgctgacytgtgtttcctccccagtcatctttcytgttccagagaggtggggctggatgtctccatctctgtctcaactttayrtgcactgagctgcaacttcttacttccctactgaaaataagaatctgaatataaatttgttttctcaaatatttgctatgagaggttgatggattaattaaataagtcaattcctggaatktgagagagcaaataaagacctgagaaccttccagaatctgc

SEQ ID NO: 286 - DNA, 1524 bp, Homo sapiens
atgcgggtcatggcgccccgarccctcmtcctgctgctctcgggagscctggccctgaycgagacctgggcckgctcccactccatgaggtatttckhcacmkcygtgtccyggccyrgccgcggrgagccccrcttcatckcagtgggctacgtggacgacacscagttcgtgcrgttcgacagcgacgccgcgagtccragagrggagccscgggmgccgtgggtggagcaggaggggccggartattgggaccgggagacacagaagtacaagcgccaggcacaggctgaccgagtgarcctgcggaacctgcgcggctactacaaccagagcgaggmcgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcwcccagcgcaagtgggaggcggcccgtgaggcggagsagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggasaagagcagagatacacgtgccatrtgcagcacgaggggctgcmagagcccctcaccctgagctggrrgccrtcttcccagcccaccatccccatcrtgggcatcgttgctggcctggctgtcctggytgtcctagctgtcctaggagctrtgrtsgcygytrtkatgygtaggaggaagagctcaggtggaaaaggagggagctgctctcaggctgcgtscagcaacagtgcccagggctctgatgagtctctcatcrcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccacygtgacccctgtccccacactgacctgtgttycctccccgrtcatctttcctgttccagagargtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 287 - DNA, 2543 bp, Homo sapiens
acgccgagatgcgggtcacggcgccccgaaccctcctcctgctgctctggggggcagtggccctgaccgagacctgggccggtgagtgcgggatcgggagggaaatggcctctgtggggaggagcgaggggaccgcaggcgggggcgcaggacccggggagccgcgccgggaggagggtctggcgggtctcagcccctcctggcccccaggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgmgctcctggaccgcggcggacaccgcggctcagatcacccagcgcaagtgggaggcggcccgtswggcggagcagctgagagcctacctggagggcctgtgcgtggagtsgctccgcagatacctggagaacgggaaggasacgctgsagcgcgcgggtaccaggggcagtggggagccttccccatctcctatagacgccgagatgctggtcatggcgccccgaaccgtcctcctgctgctctcggcggccctggccctgaccgagacctgggccgaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttatgcgggtcatggcgccccgarccctcmtcctgctgctctcgggagscctggccctgaycgagacctgggcckgctcccactccatgaggtatttckhcacmkcygtgtccyggccyrgccgcggrgagccccrcttcatckcagtgggctacgtggacgacacscagttcgtgcrgttcgacagcgacgccgcgagtccragagrggagccscgggmgccgtgggtggagcaggaggggccggartattgggaccgggagacacagaagtacaagcgccaggcacaggctgaccgagtgarcctgcggaacctgcgcggctactacaaccagagcgaggmcgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcwcccagcgcaagtgggaggcggcccgtgaggcggagsagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggasaagagcagagatacacgtgccatrtgcagcacgaggggctgcmagagcccctcaccctgagctggrrgccrtcttcccagcccaccatccccatcrtgggcatcgttgctggcctggctgtcctggytgtcctagctgtcctaggagctrtgrtsgcygytrtkatgygtaggaggaagagctcaggtggaaaaggagggagctgctctcaggctgcgtscagcaacagtgcccagggctctgatgagtctctcatcrcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccacygtgacccctgtccccacactgacctgtgttycctccccgrtcatctttcctgttccagagargtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 288 - DNA, 1543 bp, Homo sapiens
aatcagtgtcgccgsggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgmgctcctggaccgcggcggacaccgcggctcagatcacccagcgcaagtgggaggcggcccgtswggcggagcagctgagagcctacctggagggcctgtgcgtggagtsgctccgcagatacctggagaacgggaaggasacgctgsagcgcgcggaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttgtggagaccagaccagcaggagayagaaccttccagaagtggrcagctgtggtggtgccttctggagaagagcagagatacacatgccatgtacagcatgaggggctgccraagcccctcaccctgagatgggagccrtcttcccagtccaccrtccccatygtgggcattgttgctggcctggctgtcctagcagttgtggtcatcggagctgtggtcgctrctgtgatgtgtaggaggaagagytcaggtggaaaaggagggagctactctcaggctgcgtgcagcgacagtgcccagggctctgatgtgtctctcacagcttgaaaagcctgagacagctgtcttgtgagggacygagatgcaggatttcttcackcctcccctttgtgacttcaagascctctggcatctctttctgcaaaggcacctgaatgtgtctgcgtccctgttagcataatgtgaggaggtggagagacagcccamccyygtgtccacygtgacccctgttcccatgctgacytgtgtttcctccccagtcatctttcytgttccagagaggtggggctggatgtctccatctctgtctcaactttayrtgcactgagctgcaacttcttacttccctaagaggttgatggattaattaaataagtcaattcctggaatktgagagagcaaataaagacctgagaaccttccagaa

SEQ ID NO: 289 - DNA, 1578 bp, Homo sapiens
ggttctraagtccccagtcacccacccggactcrsattctccccagasgccgagatgcgggtcatggcgccccgarccctcmtcctgctgctctcgggagscctggccctgaycgagacctgggcckgctcccactccatgaggtatttckhcacmkcygtgtccyggccyrgccgcggrgagccccrcttcatckcagtgggctacgtggacgacacscagttcgtgcrgttcgacagcgacgccgcgagtccragagrggagccscgggmgccgtgggtggagcaggaggggccggartattgggaccgggagacacagaagtacaagcgccaggcacaggctgaccgagtgarcctgcggaacctgcgcggctactacaaccagagcgaggmcgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcwcccagcgcaagtgggaggcggcccgtgaggcggagsagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggasaagagcagagatacacgtgccatrtgcagcacgaggggctgcmagagcccctcaccctgagctggrrgccrtcttcccagcccaccatccccatcrtgggcatcgttgctggcctggctgtcctggytgtcctagctgtcctaggagctrtgrtsgcygytrtkatgygtaggaggaagagctcaggtggaaaaggagggagctgctctcaggctgcgtscagcaacagtgcccagggctctgatgagtctctcatcrcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccacygtgacccctgtccccacactgacctgtgttycctccccgrtcatctttcctgttccagagargtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 290 - DNA, 1549 bp, Homo sapiens
gaattcgggggggagatgcgggtcatggcgccccgaaccctcatcctgctgctctcgggagccctggccctgaccgagacctgggccggctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggmgccgtgggtggagcaggaggggccggartattgggaccgggagacacagaagtacaagcgccaggcacaggctgaccgagtgarcctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcwcccagcgcaagtgggaggcggcccgtgaggcggagsagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgttcagcacgaggggctgccggagcccctcaccctgagatggaagccgtcttcccagcccaccatccccatcgtgggcatcgttgctggcctggctgtcctggctgtcctagctgtcctaggagctatggtggctgttgtgatgtgtaggaggaagagctcaggtggaaaaggagggagctgctctcaggctgcgtccagcaacagtgcccagggctctgatgagtctctcatcrcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccacygtgacccctgtccccacactgacctgtgttccctccccgatcatctttcctgttccagagaagtgggctggatgtctccatctctgtctcaacttcatggtgcgctgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaaaaacccgcccgaattc

SEQ ID NO: 291 - DNA, 20637 bp, Homo sapiens
  misc_feature (1)...(20637): n = A,T,C or G, or insertion/deletion polymorphism (see Tables 1-2)
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggcngatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgrtaacattagcacagttaagaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaacccctctacctgtcactcctgagatggagagagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 292 - DNA, 4387 bp, Homo sapiens
  misc_feature (1)...(4387): n = A,T,C or G, or insertion/deletion polymorphism (see Tables 1-2)
atgcctatgatacccctgatttcactctggctgaaaagaacaagactctctacagcaaggtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 293 - DNA, 20727 bp, Homo sapiens
  misc_feature (1)...(20727): n = A,T,C or G, or insertion/deletion polymorphism (see Tables 1-2)
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggcngatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgrtaacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 294 - DNA, 19814 bp, Homo sapiens
  misc_feature (1)...(19814): n = A,T,C or G, or insertion/deletion polymorphism (see Tables 1-2)
gactatgaaaataaaatcaaaggcaaatggagtgagacaccttgctttgaagttgcaaatgccagaatgaatgctgrtaacattagcacagttaagaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaagacagggtctcactctatcacccaggctgcagtgtggtggcatgatcacagctcgctgcagtctcgacttcatggactcaagcaatcctccagcctcagccaccagaatagctaggactacagaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 295 - DNA, 20932 bp, Homo sapiens
  misc_feature (1)...(20932): n = A,T,C or G, or insertion/deletion polymorphism (see Tables 1-2)
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggcngatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgrtaacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaagacagggtctcactctatcacccaggctgcagtgtggtggcatgatcacagctcgctgcagtctcgacttcatggactcaagcaatcctccagcctcagccaccagaatagctaggactacagaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 296 - DNA, 9436 bp, Homo sapiens
  misc_feature (1)...(9436): n = A,T,C or G, or insertion/deletion polymorphism (see Tables 1-2)
agcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagaaaacatgggcaagggaacccctctacctgtcactcctgagatggagagagtcaaacacaatcaagaaaatattagctcggttttgtacaaagaaaatgtggggaaagccaccgcaacccctgtcactcctgagatgcagagagtcaaacgcaatcaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 297 - DNA, 20634 bp, Homo sapiens
  misc_feature (1)...(20634): n = A,T,C or G, or insertion/deletion polymorphism (see Tables 1-2)
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggcngatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgrtaacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 298 - DNA, 20913 bp, Homo sapiens
  misc_feature (1)...(20913): n = A,T,C or G, or insertion/deletion polymorphism (see Tables 1-2)
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggcngatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgrtaacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactaycctaactttasaagtgtggtggatcctccagagattgttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattayagttgttcaagacacrccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 299 - DNA, 617 bp, Homo sapiens
  misc_feature (1)...(617): n = A,T,C or G, or insertion/deletion polymorphism (see Tables 1-2)
cgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattrtctaaaaacttatcttcacccagttcttacccgccagctcttgaggccragggcgaggccatggaagatgcagccgcgccagggnacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtc

SEQ ID NO: 300 - DNA, 1602 bp, Homo sapiens
  misc_feature (1)...(1602): n = A,T,C or G, or insertion/deletion polymorphism (see Tables 1-2)
cgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattrtctaaaaacttatcttcacccagttcttacccgccagctgtgaataagggcaggaaggtagytagtcccagtcccagtggcagcgtgctattcacagatgaaggggttccraaatttttgtcaagaaagactttggtagagtttccacagaaagttctgtctccattcagaaaacagggctctgattcagaagctcgtcaggtgggtcggaaagtgacgtcgccttcgtcttcatcctcntccagctcctctgattctgaatctgatgatgaggctgacgtttcagaggtcactcctcgagtggtgagcaaaggcagaggggggcttcgaaaaccagaggcctctcattcctttgaaaacagagcccccygagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcrccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccragggcgaggccatggaagatgcagccgcgccagggnacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttt

SEQ ID NO: 301 - DNA, 2078 bp, Homo sapiens
  misc_feature (1)...(2078): n = A,T,C or G, or insertion/deletion polymorphism (see Tables 1-2)
gtgaaaggtgctgtgaccgccctccgggttgtggctggtggccttcggtgtttcgggtttggcagttcactcaccaaggtgatctgatggagtgcacttcgcacgattccaagtacttgcctaatgttcatcctttcctctagacggggtagggctggttctggatctttttccgcggtagctggagagacgtaggacctgatgatggctactagatgcctgagaarggagaagacagaggagaatgccagatgaagacagaaacagagattgaagttatgtggccataattcaaggattgctggcaacaccagaagccaagagaaagatgaggaagaattctcccctagacctttcagaaggagcrtggcccagccaacaccctgacttcagacttctggcctccagaactcagcctcctggccggggatagccaatagccccagcccactgaaagcctggtgagcagaaagggaagagaaacaagggtgttcattcactggtaggatgtgtttcctgaacggctcctgctcctgctggacaagcccacagagggcccagcttccaacagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattrtctaaaaacttatcttcacccagttcttacccgccagctgtgaataagggcaggaaggtagytagtcccagtcccagtggcagcgtgctattcacagatgaaggggttccraaatttttgtcaagaaagactttggtagagtttccacagaaagttctgtctccattcagaaaacagggctctgattcagaagctcgtcaggtgggtcggaaagtgacgtcgccttcgtcttcatcctcntccagctcctctgattctgaatctgatgatgaggctgacgtttcagaggtcactcctcgagtggtgagcaaaggcagaggggggcttcgaaaaccagaggcctctcattcctttgaaaacagagcccccygagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcrccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccragggcgaggccatggaagatgcagccgcgccagggnacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttt

SEQ ID NO: 302 - DNA, 4424 bp, Homo sapiens
  misc_feature (1)...(4424): n = A,T,C or G, or insertion/deletion polymorphism (see Tables 1-2)
gagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggaratgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatayacttctgtgactggcagcaggccygggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcnacagcttctgtataggtcttggttcatgtggcaccagcaggcagcagcacgtcaccaggagcaggagtggcaaacagtggcctgtgcccaccaccgccacgggcggctcaagaaagctttctgcctytggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctscacagggcgctgcaggcatgggtgacttaccagggcagggtncgaagcatcctccgggaggtggcagccagggagagccagcacaacaggcagctgctgygcggggcattacgtcgctggaaagagaacaccatggccsgagtggatgaagccaaaaaaacctttcaagcaagtactcattacagaaggaccatatgttccaaggtcctggtscagtggcgggaagctgtgtcagtgcagatgtattaccgacagcaggaggactgtgccatctgggaggcccagaaggtgctggacaggggctgtctgcggacctggtttcagcrctggtgggactgcagccggaggtcagcccagcagagactgcagctggagagggcagtgcaacaccaccaccggcagctgctgctggaggggctggcccggtggaagacgcwccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacrgcaagcacaggcccggagctgctgctgctgcctcyttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccrgggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactrtgctactgatacagttgaaaaaattcaatgatgtctctcctgcaggagaaattcacagcatccccagggtcaacatgaaatctggccctgtccccgccactgggggctccccaggcctgcgttcctgataaactgggacaggttttccaggcactgaccaactatccaccaagggtcctctgcctccaagacagaccctgaatcaatagcagcaactttcccatatttcatgtagggatatgtggagggggacaggaactctcccatttccccagctgggcctactacctgcctgccctgttcactctggtgccatgaggcaggttcagtgattgattggtcttgcctgctgcagagtctgtatcattaatcagtgtcatcagtgtcctcagaagacactagcagagtccagggtgatgcgttcagc

SEQ ID NO: 303 - DNA, 4549 bp, Homo sapiens
  misc_feature (1)...(4549): n = A,T,C or G, or insertion/deletion polymorphism (see Tables 1-2)
gagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggaratgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatayacttctgtgactggcagcaggccygggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcnacagcttctgtataggtcttggttcatgtggcaccagcaggcagcagcacgtcaccaggagcaggagtggcaaacagtggcctgtgcccaccaccgccacgggcggctcaagaaagctttctgcctytggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctscacagggcgctgcaggcatgggtgacttaccagggcagggtncgaagcatcctccgggaggtggcagccagggagagccagcacaacaggcagctgctgygcggggcattacgtcgctggaaagagaacaccatggccsgagtggatgaagccaaaaaaacctttcaagcaagtactcattacagaaggaccatatgttccaaggtcctggtscagtggcgggaagctgtgtcagtgcagatgtattaccgacagcaggaggactgtgccatctgggaggcccagaaggtgctggacaggggctgtctgcggacctggtttcagcrctggtgggactgcagccggaggtcagcccagcagagactgcagctggagagggcagtgcaacaccaccaccggcagctgctgctggaggggctggcccggtggaagacgcwccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacrgcaagcacaggcccggagctgctgctgctgcctcyttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccrgggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactrtgctactgatacagttgaaaaaattcaatgatgtctctcctgcaggagaaattcacagcatccccagggtcaacatgaaatctggccctgtccccgccactgggggctccccaggcctgcgttcctgataaactgggacaggttttccaggcactgaccaactatccaccaagggtcctctgcctccaagacagaccctgaatcaatagcagcaactttcccatatttcatgtagggatatgtggagggggacaggaactctcccatttccccagctgggcctactacctgcctgccctgttcactctggtgccatgaggcaggttcagtgattgattggtcttgcctgctgcagaggacctggccagctccagaagggtcactcatcaggtcctgcaaaggtctgtatcattaatcagtgtcatcagtgtcctcagaagacactagcagagtccagggtgatgcgttcagccacaagcacaaaractgctttttctaaagagcaggatgaggtgaatgtgggaacggaaagcagttgtcacgaaggctgtgtggctctgctgggggagaggc

SEQ ID NO: 304 - DNA, 4403 bp, Homo sapiens
  misc_feature (1)...(4403): n = A,T,C or G, or insertion/deletion polymorphism (see Tables 1-2)
gagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggaratgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatayacttctgtgactggcagcaggccygggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcnacagcttctgtataggtcttggttcatgtggcaccagcaggcagcagcacgtcaccaggagcaggagtggcaaacagtggcctgtgcccaccaccgccacgggcggctcaagaaagctttctgcctytggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctscacagggcgctgcaggcatgggtgacttaccagggcagggtncgaagcatcctccgggaggtggcagccagggagagccagcacaacaggcagctgctgygcggggcattacgtcgctggaaagagaacaccatggccsgagtggatgaagccaaaaaaacctttcaagcaagtactcattacagaaggaccatatgttccaaggtcctggtscagtggcgggaagctgtgtcagtgcagatgtattaccgacagcaggaggactgtgccatctgggaggcccagaaggtgctggacaggggctgtctgcggacctggtttcagcrctggtgggactgcagccggaggtcagcccagcagagactgcagctggagagggcagtgcaacaccaccaccggcagctgctgctggaggggctggcccggtggaagacgcwccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacrgcaagcacaggcccggagctgctgctgctgcctcyttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccrgggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactrtgctactgatacagttgaaaaaattcaatgatgtctctcctgcaggagaaattcacagcatccccagggtcaacatgaaatctggccctgtccccgccactgggggctccccaggcctgcgttcctgataaactgggacaggttttccaggcactgaccaactatccaccaagggtcctctgcctccaagacagaccctgaatcaatagcagcaactttcccatatttcatgtagggatatgtggagggggacaggaactctcccatttccccagctgggcctactacctgcctgccctgttcactctggtgccatgaggcaggttcagtgattgattggtcttgcctgctgcagagtctgtatcattaatcagtgtcatcagtgtcctcagaagacactagcagagtccagggtgatgcgttcagc

SEQ ID NO: 305 - DNA, 2572 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccrgcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 306 - DNA, 2592 bp, Homo sapiens
tcttcttggccaacaagcgtttctccctcttccctgttctccccacttccccacttcatcccccttcatccccccttcctcgcccctccacagacccagggcatttggtggacacttttgcttgcagttaggtcaagtggagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 307 - DNA, 2877 bp, Homo sapiens
caagctcctcatycagggcctgaggctcccacctcgtgtcacctcaagacagccagagaggatgaaatctttggcttgggcttccagggctgtcataggcagagggcaagccaggatttgaaatagggaggccagaaacactgctggccaaggaagtggcttggccttgggaagcaagaaggcagcaacctctaggcgccccttctctccatcctgcagctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 308 - DNA, 2791 bp, Homo sapiens
cgctgagaaggagcagacaagatggcgacgtccgtggggcaccgatgtctgggattactgcacggggtcgcgcccttggttatagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccrgcagtatgagaagtacagggagcgagagctggagaagctgggattggagattccacccaaacttgctggtcactgggagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 309 - DNA, 2619 bp, Homo sapiens
gagtgagcggagccggcgccccggccctgccgggagccccaggtgacttctcagggaggcgccccaccctgcccgctcagagggccagtgccgggtgggggtgcccttctagggccttcggtcgcaggtgggctctcccagctgtgacgacgcggccccggcctgaggagccccgcggacaaggttgagcgagtcgtgggctttttttccgtccccacgtgggcacggcccgggctgcgtgagctcacttcctccacatcttatctcctgccgggcgcgggcgcttcccatcagacagcaggagccagttctcagggtccttggctgaacacacaagctgcaaagctacatatactccggcagagctggctgcgggctgcagactgcagggccggtcactccgcgcaagtttgggttcctgttttagaactgccacctaagcccctcttatttcatctttcctgtggtggaaacccctgcccccaccggagtgtgaggttgactttttggaaagagagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcag

SEQ ID NO: 310 - DNA, 2639 bp, Homo sapiens
ccttcatccccccttcctcgcccctccacagacccagggcatttggtggacacttttgcttgcagttaggtcaagtggaggtatggaagaacatggaaatccatggaggaggaccctatctgtcttcttccccctgccgcatcccagggctgtggcttgtcatgtggcacttgcttgggctggatccagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 311 - DNA, 2968 bp, Homo sapiens
gagtgagcggagccggcgccccggccctgccgggagccccaggtgacttctcagggaggcgccccaccctgcccgctcagagggccagtgccgggtgggggtgcccttctagggccttcggtcgcaggtgggctctcccagctgtgacgacgcggccccggcctgaggagccccgcggacaaggttgagcgagtcgtgggctttttttccgtccccacgtgggcacggcccgggctgcgtgagctcacttcctccacatcttatctcctgccgggcgcgggcgcttcccatcagacagcaggagccagttctcagggtccttggctgaacacacaagctgcaaagctacatatactccggcagagctggctgcgggctgcagactgcagggccggtcactccgcgcaagtttgggttcctgttttagaactgccacctaagcccctcttatttcatctttcctgtggtggaaacccctgcccccaccggagtgtgaggttgactttttggaaagagagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 312 - DNA, 885 bp, Homo sapiens
atgagacactccgtggcgcgcccaacacggttacccaggcgcctatcacccttctgggacccggccacctgtaagaacctggagggcggagcgggcgaggttgttcggggaagggatccccggcggctgaggacatccaggagcaccgagattcttggggaggacctcgccgggcccagcgcaggagccgccgcgcgtccagcggctccaccgccgcagcctcgggaaccgggcgccccaggtctcaggcgcgccccgccgcggacgcgaatggactcgtccggcctcggcccctgcagcgaagctccgcttcacaccagcgctgggctgtccggccgcaacctgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagctcggagcagcgacggccggctccgccacccggcctggcgcgcaggcagcggcgggcgaggagggcgtgggcccagcgcggaactggcctccsgatactggggcagacggcgcgctctgcccggggccgccgacctccggccgaagggagcgcgggcggacgacaggcgaccactgcgcgcaggccggaagctccatctgcccgaagctgcgaggctgccagggaatgtaggcaagtcgggggagccccacaaagctggcgaggtcgggaatcaccccagggattcg

SEQ ID NO: 313 - DNA, 6504 bp, Homo sapiens
gcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagyggaaataaggaaacagtttactctcccaccaaaccttggccagtaccatcgacagagcataagtacctctggcttcccctctcttcaactacctcagttttatgaccctgtggakccagtgractttgaaggacttctgatgacacacctgaacagcctggatgtgcagcttgcccaggagctcggggacttcactgatgacgacttggacgtggtgttcacgmcaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaayaggcaggccragctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgarctcacacgccttcagtggccgcatcaagtcaggcgagatctgcagtcttctcagtcacctacccrtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcartgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctaygtctacccacagaggctgaactttgtaaacaaactagcatcagcccggaacattacaataaagatccagtttatgtgtggagaagatgctagcaatgygatgccggtcatctttggaaartccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagygagatggcgctggagcatgagctgaagctcagcatcatctgcctsaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcacyggaatggtgagagaaacagtcttcaagtatgcctggttcttctttgagcttctggtgaaaagcatggcccagcacgtacataacatggacaaacgggacagtttycggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcarccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttygatctgacttccgagtacygccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctscgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcaygccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggarctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggartttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccrattgaagttgccattgaagacatgaagaagaagaccctgcagttagcagttgccattaaccaggagccgcctgatscaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagaacattgtgctgtytgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaata

SEQ ID NO: 314 - DNA, 2075 bp, Homo sapiens
ggctgccttcttcgagaatggtgtcaacccttaataacacctagccttacgaatccctggggtgattcccgacctcgccagctttgtggggctcccccgacttgcctacattccctggcagcctcgcagcttcgggcagatggagcttccggcctgcgcgcagtggtcgcctgtcgtccgcccgcgctcccttcggccggaggtcggcggccccgggcagagcgcgccgtctgccccagtatcsggaggccagttccgcgctgggcccacgccctcctcgcccgccgctgcctgcgcgccaggccgggtggcggagccggccgtcgctgctccgagctcggaccctcccccggggtgatttcggcttagaaggtggaaatgcggaagtttccagcgccgaccgacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaagggtgataggcgcctgggtaaccgtgttgggcgcgccacggagtgtctcataaacggctccttcctttgaggcaagtctgagcgcggggggaagaagtgaagtggctgaaattagagttgcgtttgaggcaggctgcaagccttctgtcgtcctgagcaaggctcygtcctcgcctgcttcattattccagaaagagcttggctcctggtggcatcgctatttttataccctggtccaaaggagccatgaagtggaaaaagtgattttttaaaaaatctacacttaaataaaccaaaagaaatggcctgtggctgacattttgagatttacagaactccagcaaaaagctaaggactgggggatcccaactcaccatccaattcctaatcaaagttgcacaaactaaatatgtaagcacatttactgctcaaagttctcagtaaaggtgctttaactgcagtttttcctccactaaaaactgctgacaagtaattgggacatttttgtcttgccctgagaaagctagactgtctagttaaaagataataggaaactcattctaaagtgtcaacttattctattgcccacagggctgtccgatttgttaatcttcacttagctgagcctgtgaaaggtggattccaccgtaggttcatctttgtgctgttagtgtgtgaagaggtttgaacaaggaattaaaagcctagaaaaacaaggcgataaggtcttctagagggcatatcgagctttattgacgattttatttccacttgatacgtgactgccagcaaactgtttctcttaccttactatttcgtcatctgtaaaatgagtttaattatttatgtatattgcatattaatgttggaggccaaaaggtactagtcaaaaggcataaagaggctgggtgccatggctcacacctctaatcccagcaatttgggaggcccagatgggaggattacttgagcccagagtttgagaccagcctgggcaacatagtgggacccctgtggctacaaaaaaataattttaaaacattagccaggtgtggttgcatgcacctgtagccccagctattcaagaggctgagacaagagcatcgcttgagcccaggaggatcacagctgtgatcatgccactgcaytccagcctgggtgagagagtgaaaccttgtctcaaaaaacagac

SEQ ID NO: 315 - DNA, 7552 bp, Homo sapiens
gcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagyggaaataaggaaacagtttactctcccaccaaaccttggccagtaccatcgacagagcataagtacctctggcttcccctctcttcaactacctcagttttatgaccctgtggakccagtgractttgaaggacttctgatgacacacctgaacagcctggatgtgcagcttgcccaggagctcggggacttcactgatgacgacttggacgtggtgttcacgmcaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaayaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgarctcacacgccttcagtggccgcatcaagtcaggcgagatctgcagtcttctcagtcacctacccrtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcartgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctaygtctacccacagaggctgaactttgtaaacaaactagcatcagcccggaacattacaataaagatccagtttatgtgtggagaagatgctagcaatgygatgccggtcatctttggaaartccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagygagatggcgctggagcatgagctgaagctcagcatcatctgcctsaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcacyggaatggtgagagaaacagtcttcaagtatgcctggttcttctttgagcttctggtgaaaagcatggcccagcacgtacataacatggacaaacgggacagtttycggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcarccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttygatctgacttccgagtacygccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctscgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcaygccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggarctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggartttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccrattgaagttgccattgaagacatgaagaagaagaccctgcagttagcagttgccattaaccaggagccgcctgatscaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgtttycatttcagaacattgtgctgtytgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgc

SEQ ID NO: 316 - DNA, 7327 bp, Homo sapiens
attttgtctcctgtaacaatttacgcgccgtgtaactgtgaatctttcaaagcctcagttttatgaccctgtggakccagtgractttgaaggacttctgatgacacacctgaacagcctggatgtgcagcttgcccaggagctcggggacttcactgatgacgacttggacgtggtgttcacgmcaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaayaggcaggccragctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgarctcacacgccttcagtggccgcatcaagtcaggcgagatctgcagtcttctcagtcacctacccrtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcartgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctaygtctacccacagaggctgaactttgtaaacaaactagcatcagcccggaacattacaataaagatccagtttatgtgtggagaagatgctagcaatgygatgccggtcatctttggaaartccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagygagatggcgctggagcatgagctgaagctcagcatcatctgcctsaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcacyggaatggtgagagaaacagtcttcaagtatgcctggttcttctttgagcttctggtgaaaagcatggcccagcacgtacataacatggacaaacgggacagtttycggaggactcgtttttctgaccgtttcatggatgacataactactattgttaatgtggaaaatgaacaggcggaaaagatgaacatcagcctggctttcttcttgtatgaccttctctccctcatggatcggggctttgtgtttaacctcatcagacattattgcarccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttygatctgacttccgagtacygccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctscgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcaygccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggarctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggartttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccrattgaagttgccattgaagacatgaagaagaagaccctgcagttagcagttgccattaaccaggagccgcctgatscaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgtttycatttcagaacattgtgctgtytgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgc

SEQ ID NO: 317 - DNA, 1271 bp, Homo sapiens
gcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttayagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcycagctgtgcctagggcgcccctcctaccccggctgcttggcagttgcagtgctgctgtctcgggggggttttcatctatgagggtgtttcctctaaacctacgagggaggaacmcctgatcttacagaaaataccayctcgagatgggtgctggtcctgttgatcccagtytytgccagaccaaggcgagtttccccactaataaagtgccgggtgtcagca

SEQ ID NO: 318 - DNA, 1415 bp, Homo sapiens
gcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttayagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcycagctgtgcctagggcgcccctcctaccccggctgcttggcagttgcagtgctgctgtctcgggggggttttcatctatgagggtgtttcctctaaacctacgagggaggaacmcctgatcttacagaaaataccayctcgagatgggtgctggtcctgttgatcccagtytytgccagaccaaggcgagtttccccactaataaagtgccgggtgtcagcagaa

SEQ ID NO: 319 - DNA, 1134 bp, Homo sapiens
cgacccctcgaggggcccagccttggaagggtaactggaccgctgccgcctggttgcctgggccagaccagacatgcctgctgctccttccggcttaggaggagcacgcgtcccgctcgggcgcactctccagccttttcctggctgaggaggggccgagcctccggtagggcgggggccggatgaggcgggacctcaggcccggaaaactgcctgtgccacgtgacccgccgccggccagttaaaaggaggcgcctgctggcctccccttacygtgcttgttcggggcgctccgctggcttcttggacaattgcgccatgtgtgctgctcggctagcggcggcggcggcccagtcggtgtatgccttctcggcgcgcccgttggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcycagctgtgcctagggcgcccctcctaccccggctgcttggcagttgcagtgctgctgtctcgggggggttttcatctatgagggtgtttcctctaaacctacgagggaggaacmccttgatcttacagaaaataccayctcgagatgggtgctggtcctgttgatcccagtctctgccagaccaaggcgagtttccccactaataaagtgccgggtgtcagca

SEQ ID NO: 320 - DNA, 5739 bp, Homo sapiens
  misc_feature (1)...(5739): n = A,T,C or G, or insertion/deletion polymorphism (see Tables 1-2)
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgancctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggactggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccrctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagyagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccrtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtncagcaggtcatcccwcccttcwtctctctcctttggcgtttgttcctgtagtcactgsgctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 321 - DNA, 5336 bp, Homo sapiens
  misc_feature (1)...(5336): n = A,T,C or G, or insertion/deletion polymorphism (see Tables 1-2)
cggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgancctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaaggcaactggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccrctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagyagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccrtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagcccccwcccttcwtctctctcctttggcgtttgttcctgtagtcactgsgctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatct

SEQ ID NO: 322 - DNA, 5745 bp, Homo sapiens
  misc_feature (1)...(5745): n = A,T,C or G, or insertion/deletion polymorphism (see Tables 1-2)
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgancctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccrctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagyagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccrtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtncagcaggtcatcccwcccttcwtctctctcctttggcgtttgttcctgtagtcactgsgctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 323 - DNA, 5429 bp, Homo sapiens
  misc_feature (1)...(5429): n = A,T,C or G, or insertion/deletion polymorphism (see Tables 1-2)
cggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgancctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaaggcaactggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccrctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagyagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccrtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagcccccwcccttcwtctctctcctttggcgtttgttcctgtagtcactgsgctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatct

SEQ ID NO: 324 - DNA, 2669 bp, Homo sapiens
  misc_feature (1)...(2669): n = A,T,C or G, or insertion/deletion polymorphism (see Tables 1-2)
cggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgancctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggactggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggtctgtgggctgaaatacgtggtttattgtgaggacgacgtttgtcacttacctgtcctgagtctgggcgccaaggaggcatgggccgtgaaggagctgtgcaagctgacagacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaaggtagggtcatcgtccgtggttccggaccaggcctgcatcagccagcgcttcctgcagggaaccatcattgccctggtggtggtcatggccttcaggcatcacctgggagcccagcctcaggagcaaggaccacagccttgtcctagagagagggcactggatggtggctccagctctaacggtcacccttttctgtggctccagcgtggtgtccatgtccacactgtacgtgctgagcctgcgcacagaggaggacctggtagacac

SEQ ID NO: 325 - DNA, 2883 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctg

SEQ ID NO: 326 - DNA, 2857 bp, Homo sapiens
gtacagtaaggacttcaactgaccttcctcagactgaggactgttcccagtgtatacatcaagtcactgagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctg

SEQ ID NO: 327 - DNA, 2702 bp, Homo sapiens
gaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaacctagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcacggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaatttcttgattttcagctcaggctgcattctaactcatactgtgaagacaaaggtgtttttgattcagaaatatatgaaatctgcatagtcttaatttgta

SEQ ID NO: 328 - DNA, 440 bp, Homo sapiens
gtacagtaaggacttcaactgaccttcctcagactgaggactgttcccagtgtatacatcaagtcactgagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagatttcattactgtcttcagaaaacycatgatgatcctggccatgaatgaaaag

SEQ ID NO: 329 - DNA, 2719 bp, Homo sapiens
gtacagtaaggacttcaactgaccttcctcagactgaggactgttcccagtgtatacatcaagtcactgagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaatttcttgattttcagctcaggctgcattctaactcatactgtgaagacaaaggtgtttttgattcagaaatatatgaaatctgcatagtcttaatttgta

SEQ ID NO: 330 - DNA, 2786 bp, Homo sapiens
agtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctg

SEQ ID NO: 331 - DNA, 2940 bp, Homo sapiens
gaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaacctagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctg

SEQ ID NO: 332 - DNA, 2600 bp, Homo sapiens
ggttaggaagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacrgcaatgatctttacctgyttcaccctcagtgcactctatgccaggcgccgtagctacctctttctgggaggtatcttgatgtcagccctgagcttgttgcttttgtcttccctggggaatgttttctttggatccatttggcctttccaggcaaacctgtatgtgggactggtggtcatgtgtggcttcgtccttgttgatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagccagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccgccccttgcctgaccctcagggagtcagcctgcttccatccatgggtgggaagacttcagcacaaaggaaagactaattcttgtcaggcatttttgaaaaggctgattatgtgtatcaaggtacagctacgtaggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaaaaaaaaaaaaaaaaaaaaaaaa

SEQ ID NO: 333 - DNA, 2965 bp, Homo sapiens
ctggatggactagccggggccatggccggcgcggcrgcggagtcagggcgggagctgtggaccttcgcgggttcccgggacccgagcgcaccgcggctagcctacggctacggcccgggcagcctgcgcgagctgcgggcgcgcgagttcagccgcctggcaggaactgtctatcttgaccatgcaggtgccaccttgttctcccagagccagctcgaaagcttcactagtgatctcatggaaaacacttatggtaatcctcacagccagaacatcagcagcaagctcacccatgacactgtggagcaggtgcgctacagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccaycccggtcaggccagaggacctgtggtctgcagaggaacgtggtgcttcagccagcaacccagactgccagctgccrcatctcttctgctacccagctcagagtaacttttctggagtcagataccccctgtcctggatagaagaggtcaagtctgggcggttgcrccctgtgagcacgcctgggaagtggtttgtgctgctggatgcagcctcctaygtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtttgaagatggcaccatctcattccttgatgttatcgcrctaaaacatggatttgacaccctagagcgcctcacaggtggaatggagaatataaagcagcacaccttcaccttggctcagtatacctacrtggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtggacaaaatggccagtctttacaacatccacctgcgaactggctgcttctgtaacactggggcctgccagaggcacctgggcataagcracgagatggtcaggaagcattttcaggctggtcatgtctgtggggacaatatggacctcatagatgggcagcccacaggatctgtgaggatttcatttggatacatgtcgacrctggatgatgtccaggcctttcttaggttcatcatagacactygcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtmatttgatcaaacaaagttcaaactctcaaaggaatgcaaagaagaaacatggaaaagatcaacttcctggtacaatggccaccctttctctggtgaatgaggcacagtatctgctgatcaacacatccagtattttggaacttcaccggcaactaaacaccagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggttttggggccttgtcacagatgccagatgatttgcatcgaccagcaaactgggcaacgaaaccagcatgttttccaaaaactttctgagagtcgtgaaacaaaggtgaactttggcatgtacctgatgcatgcatcattggatttatcctccccatgtttcctgtctgtaggatctcaggtgctccctgygttgaaagagaatgtggaaggtcatgatttacctgcatctgagaaacaccaggatgttacctcctaaaaaaaatttttagcatacattaaagtttctcttttacagtgatctctattattgttaagatctgcaacttggttcagtagaacttgatgttttgaataaggagagctctttttctttagaggcagggaatgctctcacctgcttccttctgcctttgacttctcaccctgcaaatttgcactggctgtgctcaggagagcacttctgaggcctcaggaacgaatgctgcacccacatccagtgaggctcctgtaggtatttgaagtataatcacttg

SEQ ID NO: 334 - DNA, 3228 bp, Homo sapiens
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgcygactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccrgcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtaygaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgsccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcycccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtc

SEQ ID NO: 335 - DNA, 3006 bp, Homo sapiens
atgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgcygactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccrgcaaagcaaagaaattgcagaggggatgatcagcgaaatccggaccgcatttgaggaggccctgggacagctggtttggatggatgagaagacccgccaggcagccaaggagaaagtgagcratgccatctatgatatgattggtttcccagactttatcctggagcccaaagagctggatgatgtttatgacgggtaygaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgsccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcycccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtc

SEQ ID NO: 336 - DNA, 3231 bp, Homo sapiens
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgcygactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccrgcaaagcaaagaaattgcagaggggatgatcagcgaaatccggaccgcatttgaggaggccctgggacagctggtttggatggatgagaagacccgccaggcagccaaggagaaagtgagcratgccatctatgatatgattggtttcccagactttatcctggagcccaaagagctggatgatgtttatgacgggtaygaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgsccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcycccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtc

SEQ ID NO: 337 - DNA, 1484 bp, Homo sapiens
camcaggctaagcgccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccarcgccccgccttctgcatcctgccttccgtattggctgaagggccggcggctctggctgccmggcggttgagagcatggcctctccaggggcmggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggtgggtaatcccggcgcggccccgccaggtagagctggcaggaccggcgccgcatgggcttggcctggtccgctttcctcccgcctgtctatccctcttggaggacgcctgcgttgggacgcgagatccagctccttcagagtcccggctgtatttagtcaaggcwaacaggagtaagagattgttggtcccggggccctctggagaaagacagtccctcagagtttgagcgttgggggtacccaagaccctgtccggaccctcgggaggcaggcagccttggggaccggattgctcagaggaccgagatcaagtcctagcgctaattgacttgtaaaacttaggacaagtcatgaacccgttctgagctttagattcagttctagaaatggtactgcgagttcacatcggaggcggcacgcgcaggcacctcgagaataatgcccagcgcttttctttttgcccctgggcactgggagccagagtcacctagagagagtcctgtctgaaacttggtcctatgccttagagagtgagaacagcaccctctaggggtggaggggagattgccgcccagggtgatacgattccccaaagggagacgtgctggaggaaaggtag

SEQ ID NO: 338 - DNA, 2012 bp, Homo sapiens
  misc_feature (1)...(2012): n = A,T,C or G, or insertion/deletion polymorphism (see Tables 1-2)
ggctgaagggccggcggctctggctgccmggcggttgagagcatggcctctccaggggcmggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggttnatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctytgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaarataragggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccrttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaargtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatgagcagagccagtaaacaaagagtcggatataaaaatacaaatgtgctgaggaagtcccttagaaagaggctgaggctggggtcacgccagacaggggtgggggcgaggaacggcccggaggactgggctcaagtgggtggaaagctcatgcaagtacgcagccaaacatccctggccgcgcgcggtccgacac

SEQ ID NO: 339 - DNA, 3159 bp, Homo sapiens
atgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgcygactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccrgcaaagcaaagaaattgcagaggggatgatcagcgaaatccggaccgcatttgaggaggccctgggacagctggtttggatggatgagaagacccgccaggcagccaaggagaaagtgagcratgccatctatgatatgattggtttcccagactttatcctggagcccaaagagctggatgatgtttatgacgggtaygaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgsccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcycccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtc

SEQ ID NO: 340 - DNA, 5041 bp, Homo sapiens
  misc_feature (1)...(5041): n = A,T,C or G, or insertion/deletion polymorphism (see Tables 1-2)
cgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttc

SEQ ID NO: 341 - DNA, 5433 bp, Homo sapiens
  misc_feature (1)...(5433): n = A,T,C or G, or insertion/deletion polymorphism (see Tables 1-2)
gaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgmacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccacyggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctat

SEQ ID NO: 342 - DNA, 5015 bp, Homo sapiens
  misc_feature (1)...(5015): n = A,T,C or G, or insertion/deletion polymorphism (see Tables 1-2)
cctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttc

SEQ ID NO: 343 - DNA, 5147 bp, Homo sapiens
  misc_feature (1)...(5147): n = A,T,C or G, or insertion/deletion polymorphism (see Tables 1-2)
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctat

SEQ ID NO: 344 - DNA, 5761 bp, Homo sapiens
  misc_feature (1)...(5761): n = A,T,C or G, or insertion/deletion polymorphism (see Tables 1-2)
gaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgmacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccacyggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaagcgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttc

SEQ ID NO: 345 - DNA, 4990 bp, Homo sapiens
  misc_feature (1)...(4990): n = A,T,C or G, or insertion/deletion polymorphism (see Tables 1-2)
cggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttc

SEQ ID NO: 346 - DNA, 5054 bp, Homo sapiens
atgggagacgtaaaagcgttgctgtttgtcgttgctgcccgggccagacgtttaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcttctgtcccccggacttcgctggcaagttctgccagttrcactcctcgggcgcccggcccccggccccggctrtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcscaggcctgtgtggccgaggggsctgcaagaacctgcctggctctttccgctgtgtttgcccggctggcttccggggctcggcgtgtgaagaggatgtggatgagtgtgcccaggarccgccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggscggtgtgagaacacagaaggcagcttccagtgtgtctgccccatgggcttccaacccaacactgctggctccgagtgcgaagatgtggatgaatgtgaaaaccacctcgcatgccctgggcaggartgtgtgaactcgcccggctccttccagtgcaggrcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggyccggacctcgcctcctgyctcgacgtggacgaatgtcgcgagcgaggyccagccctgtgcgggtcgcagcgytgtgagaaytctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgyacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgttggcatgtccccaggctcgcagccccaggcacctgttagccccgttctgcccgccaggccacctccgccacccctgtcccgccgacccagaaaacctaggaagggccctgtggggagtgggtgccgggagtgctattttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggaggcggaggagtgcgggatcctggacggctgcaccaacgrccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaaaaaaaaaaaaaaaaaaa

SEQ ID NO: 347 - DNA, 1855 bp, Homo sapiens
  misc_feature (1)...(1855): n = A,T,C or G, or insertion/deletion polymorphism (see Tables 1-2)
ctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatsaacccggccgcgctastcagggctcagcagtgccccagcatggggcagagcctctcggtgccagccagctcctgtgtcctaccracctctccactgtatctgggaattgccaaggagaagagtaccaaggctgctagtgaacagcgacntgctgcacggaacgtcatgaaggaccaacgcctggttttccatagtaaagttaggtcrtctggttatgcgtcagcaccacatgtaactatgttttcacyaaasaccaacatcaagagtgaggggaaaggatcttcaaggagcaggagcagctgcgcacgggaggcataccccntggagtgcgctgtgcccaccaagcccggcccccaggtcgctgccgcccccwcctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgatataaacagaagagcaagtccaagctgatttgcaggctctccacgacgggtgcagtagacatgaccagtttatcggcagtcaacracttttattcccacatcgtactcgcagctggccggaacaggaccgtggaagtgtttgacctcaacgccggctgcagtgcagcggtgatagyggaagcccactcacggcctgtccatcaaatctgccaaaataaatatttcagcagrgccatcgtggacccagaagaactccatgacctgctgctggcgcggacactccaggactcagcctttggctttccatagtggtgacataagagaagcagctacgtgtgtgtttattccagatgccaagtgaagcctagaacaggagttgcatcttgcaggtcccctcagtggatgggcyrggccccgagggtgagggctgccacagttgactgcccagccaggctgtgggacggctgctcttgtactctccatgctctgactcaagggaacctgtgttcctggtctcgtgccatctacctggagctgcagtgaacacacatctcgaatttttcatcccatggggttgcatggctgcggctcacgtgtctcatgggccaggcatcagtcacaggccacagcaagggctctagttgacggtcaggtgagctctcttctcagtggttgtcaaactctcatgggaaaattatttaattaaattggttacttta

SEQ ID NO: 348 - DNA, 1048 bp, Homo sapiens
  misc_feature (1)...(1048): n = A,T,C or G, or insertion/deletion polymorphism (see Tables 1-2)
ctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatsaacccggccgcgctastcagggctcagcagtgccccagcatggggcagagcctctcggtgccagccagctcctgtgtcctaccracctctccactgtatctgggaattgccaaggagaagagtaccaaggctgctagtgaacagcgacntgctgcacggaacgtcatgaaggaccaacgcctggttttccatagtaaagttaggtcrtctggttatgcgtcagcaccacatgtaactatgttttcacyaaasaccaacatcaagagtgaggggaaaggatcttcaaggagcaggagcagctgcgcacgggaggcataccccntggagtgcgctgtgcccaccaagcccggcccccaggtcgctgccgcccccwcctgcacacgtgtatgctgcatccagtactcaggtgcgccacgtcctgcgggagctgggtagcatttcattgtaagagtctttgattctgcccactgtaaacatttttctattgtatcataattgtaaatatatttttaaaaaccttggttacttgaa

SEQ ID NO: 349 - DNA, 1453 bp, Homo sapiens
  misc_feature (1)...(1453): n = A,T,C or G, or insertion/deletion polymorphism (see Tables 1-2)
ctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatsaacccggccgcgctastcagggctcagcagtgccccagcatggggcagagcctctcggtgccagccagctcctgtgtcctaccracctctccactgtatctgggaattgccaaggagaagagtaccaaggctgctagtgaacagcgacntgctgcacggaacgtcatgaaggaccaacgcctggttttccatagtaaagttaggtcrtctggttatgcgtcagcaccacatgtaactatgttttcacyaaasaccaacatcaagagtgaggggaaaggatcttcaaggagcaggagcagctgcgcacgggaggcataccccntggagtgcgctgtgcccaccaagcccggcccccaggtcgctgccgcccccwcctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgatataaacagaagagcaagtccaagctgatttgcaggctctccacgacgggtgcagtagacatgaccagtttatcggcagtcaacracttttattcccacatcgtactcgcagctggccggaacaggaccgtggaagtgtttgacctcaacgccggctgcagtgcagcggtgatagyggaagcccactcacggcctgtccatcaaatctgccaaaataaaggttcatcatttacaacccaacagcctcaggcttataaccttttcctgaccacggccattggcgatgggatgagactgtgggacctgagaaccctgag

SEQ ID NO: 350 - DNA, 2099 bp, Homo sapiens
  misc_feature (1)...(2099): n = A,T,C or G, or insertion/deletion polymorphism (see Tables 1-2)
ctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatsaacccggccgcgctastcagggctcagcagtgccccagcatggggcagagcctctcggtgccagccagctcctgtgtcctaccracctctccactgtatctgggaattgccaaggagaagagtaccaaggctgctagtgaacagcgacntgctgcacggaacgtcatgaaggaccaacgcctggttttccatagtaaagttaggtcrtctggttatgcgtcagcaccacatgtaactatgttttcacyaaasaccaacatcaagagtgaggggaaaggatcttcaaggagcaggagcagctgcgcacgggaggcataccccntggagtgcgctgtgcccaccaagcccggcccccaggtcgctgccgcccccwcctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgatataaacagaagagcaagtccaagctgatttgcaggctctccacgacgggtgcagtagacatgaccagtttatcggcagtcaacracttttattcccacatcgtactcgcagctggccggaacaggaccgtggaagtgtttgacctcaacgccggctgcagtgcagcggtgatagyggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgagracagacacgcttacgtgtatgaaatgggctcaagcacgttttmtcacyggctggctgggcacacagacactgtcactggagtggccttcaacccatcagcgccccagcaagtaagaacgggattttgaaaattcttatggaaaaaagtctgcagcatttccagaaactttcttaattagaagaaaacatgaaartaaccgttgcaaatcaattgtatataaaaatgaatggtcttctattaaaatgtagagggagattttttgcaaaggtgttgggattacaggcgtgagccactgcacctggccagttgagctttttaaagataacagaaaggactgctgagaatgagtaaacctatgtccgtaaagagaattgcatgatttactgcaagtattcctgggagtgaagcatcacgtacacactgctggtctcgtgtcctcctgaagatagcccctcacacttcacagtggttggagaaggttctttttctctcctgtcttccctctgggtcccacctggtctagcattttcatctgtgttgaaatttgttt

SEQ ID NO: 351 - DNA, 874 bp, Homo sapiens
  misc_feature (1)...(874): n = A,T,C or G, or insertion/deletion polymorphism (see Tables 1-2)
ctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatsaacccggccgcgctastcagggctcagcagtgccccagcatggggcagagcctctcggtgccagccagctcctgtgtcctaccracctctccactgtatctgggaattgccaaggagaagagtaccaaggctgctagtgaacagcgacntggtcatgtaactatgttttcacyaaasaccaacatcaagagtgaggggaaaggatcttcaaggagcaggagcagctgcgcacgggaggcataccccntggagtgcgctgtgcccaccaagcccggcccccaggtcgctgccgcccccwcctgcacacgtgtatgctgcatccagtactcaggtgcgccacgtcctgcgggagctggg

SEQ ID NO: 352 - DNA, 2483 bp, Homo sapiens
  misc_feature (1)...(2483): n = A,T,C or G, or insertion/deletion polymorphism (see Tables 1-2)
ctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatsaacccggccgcgctastcagggctcagcagtgccccagcatggggcagagcctctcggtgccagccagctcctgtgtcctaccracctctccactgtatctgggaattgccaaggagaagagtaccaaggctgctagtgaacagcgacntgctgcacggaacgtcatgaaggaccaacgcctggttttccatagtaaagttaggtcrtctggttatgcgtcagcaccacatgtaactatgttttcacyaaasaccaacatcaagagtgaggggaaaggatcttcaaggagcaggagcagctgcgcacgggaggcataccccntggagtgcgctgtgcccaccaagcccggcccccaggtcgctgccgcccccwcctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgatataaacagaagagcaagtccaagctgatttgcaggctctccacgacgggtgcagtagacatgaccagtttatcggcagtcaacracttttattcccacatcgtactcgcagctggccggaacaggaccgtggaagtgtttgacctcaacgccggctgcagtgcagcggtgatagyggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgagracagacacgcttacgtgtatgaaatgggctcaagcacgttttmtcacyggctggctgggcacacagacactgtcactggagtggccttcaacccatcagcgccccagggtgctggtgagagaccttacataaggaacctggagtgtgatgacgtctacggcagctcccacacttcttactccttcataacacaggcccccgacgcagccatacccgccaagtcccctttccctgtgggcgaatctgtggccgcccgttcgcagatgcccggaccgtgccaccacctccgcgtcccattcccactttcccaggttgcccctggtgccctcgcagcacccacccggcagaaaatcacctgtggactgagccggcgagttgaacttcccgaataccagaggctttccctgacactcatggaaggtcatccaattctgtctggcatccccttcatctcggagcatggccgactggtgaagtcccaccagacctgctggctgccatggggcaagttaagttgtcagctaccgaggtctttctcgttgactaaaccaccccccaaccccatgctccatgaagagcacctgtggtttccttgtggccatgagtgttgtggtgggaccagcatcaagcgcaagagatctgccgagtccacgtggatacactatgaccccgcagaccatgaagggaagggccccgttcaaatggtgtttatcacggacaaagccaaagtgtgcgtgactgacctacatgatgccagatgtgtggcatcccgggtcctccccagcagcaccgatcaccccagctgttgctctgggagtgagggctgcagcgggaacaggctgaaagtcctcgtggagctggcgtttcagcgtgtttgtgtttgtgcagtgggggagacgaacaataataacatgagtggtcatctacgtgcttat

SEQ ID NO: 353 - DNA, 2157 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcytgcgttgtttgtaggcaaatgatggtggcatctggcaatcaattagtagaatgtcaggagtgccataatctctaccaccgagattgtcataaaccscaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccytcaacagcaaaattgagttcaacaacacaaaacaatactgggaaacctgctrcttcgtcagctaaccagaaacctgtgggtttgactggtctggcaacatcatccaaaggtggaataggttccaaaataggttccaataacagcactacgcccactgtacctttaaaaccaccyccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattrcagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaatttctattgtttcttaccttaaaatgctaartattatataacaaaacttggaaactttcattttaaatcaatcttcaacatttttattctaatgatttccatagtgtgtgaaaacaatgattagaatgactggttctcaatgagatcttcagaagattgaaagcatctgtgaatttaagga

SEQ ID NO: 354 - DNA, 2319 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcytgcgttgtttgtaggcaaatgatggtggcatctggcaatcaattagtagaatgtcaggagtgccataatctctaccaccgagattgtcataaaccscaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccytcaacagcaaaattgagttcaacaacacaaaacaatactgggaaacctgctrcttcgtcagctaaccagaaacctgtgggtttgactggtctggcaacatcatccaaaggtggaataggttccaaaataggttccaataacagcactacgcccactgtacctttaaaaccaccyccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattrcagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaatttctattgtttcttaccttaaaatgctaartattatataacaaaacttggaaactttcattttaaatcaatcttcaacatttttattctaatgatttccatagtgtgtgaaaacaatgattagaatgactggttctcaatgagatcttcagaagattgaaagcatctgtgaatttaagga

SEQ ID NO: 355 - DNA, 1737 bp, Homo sapiens
atgagccaccaatttagttctcagtccgcgtttagttcaatgagcaggcgggtttatagtaccagctcttctgcaggctctggtggtgggagtccggcagtgggttctgtgtgttatgctcgagggaggtgtggtggtggtggatatgggatccatggaagggggtttggctctaggagcctctacaatctgggtggcagtagaagcatctccattaatctaatggggaggagcaccagtggtttctgccagggtgggggagtagggggatttggagggggcagaggctttggggttggcagcactggggctggtggctttggaggaggtggttttgggggtgctggatttgggactagcaattttgggcttgggggctttggtccttattgtcctcctgggggcatccaagaggtgaccattaaccagagcctcctagagccacttcacctggaggtggaccctgaaattcagaggatcaagacccaggagcgggagcagattatggttctcaacaacaagtttgcctccttcattgacaaggtgcrattcctggagcagcagaaccaggtgctacaaacaaaatgggagttgctgcagcaggtgaacacctcaactggaaccaacaacctggagcccctcttggagaactacatckgtgacctgcggaggcaggtggatttgctcagtgcggagcagatgcgccagaacgcggaggtcaggagcatgcaggatgtcgtggaggactacaagagcaagtatgaggatgaaatcaacaagagractggcagcgagaatgactttgtcgtcctgaagaaggatgtggatgctgcttatgtgagcaaagtggacctggagtccagggtggacactctgactggggaggtcaatttcttgaaatatttrtttttgacggagctgtctcaggtgcagactcacatcagcgacaccaacgtcatcctgtycatggacaataaccgttccctggacctggacagcatcatcratgcagtgcggacccrgtatgaactgattgcacagaggagcaaggacgaggccgaagccctgtaccagaccaagtaccaggagctccagatcayggcagggagacatggagaygacctgaagaacagcaagatggagattgcagagctcaaccgcaccgtccagaggctgcaggcagagatcagcaacgtgaagaagcagattgaacagatgcagtcactcatttcggatgctgaggagagaggcgagcaggccctccaggatgcgtggcagaagctgcaggacctggaggaggccctgcagcagtccaaggaggagctggcccggctgctgcgtgactaccaggccatgctgggggtcaagctgtccctggatgtggagatcgccacctaccgccagctgctggagggcgaggagagcaggatgtcaggagagctgcagagccatgtgagcatctccgtgcagaacagccaggtgagcgtcaacggyggcgcgggaggcggcggcagctacggctcaggaggctacggcggcggcagcggtgggggctatggcggcggaagaagctaccgcggaggcggggcacgagkcrgragtggaggcggttatggcagcggctgcggcggcggtggcgggagctacggagggagcggcagaagcgkccgcggatcctcgcgcgtgcagatcatccagacctccaccaacamctcccacaggcggatcttggagtag

SEQ ID NO: 356 - DNA, 3569 bp, Homo sapiens
gcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggcyctctaagaccaactccagcagtcaaacattcaaaaacgactcactttgagattgaaatatttgatgctcaaacaaggaaacagatatgtattctggataaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagtgtttttggctgaatacacaggacctctgctaatatacctcctcttttatttgaggatcccatgtatatatgatggaaaagagagtgctagaagattacgccacccagtggtacacttggcttgcttctgtcattgtatacactacatccgataccttttggaaaccttatttgttcacaaagtttctgcaggacacacacctttgaaaaatttgataatgagttgtgccttttactggggatttacttcttggattgcctactacattaatcatccactatatacaccaccatcatttggaaacaggcaaatcacagtatctgctatcaattttctgatttgtgaagctgggaatcatttcatcaatgtaatgttgtctcatcccaatcacacaggaaacaatgcctgtttcccaagtccaaattataaccccttcacatggatgtttttcctggtttcatgtcctaactacacctatgagattggatcatggattagtttcacagtcatgacacaaacactgccagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaatctgattaaaaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctagagagagccatgattaaaccaaggcactccagcctgggtgacagagtgagactgtctcaaaataaaataaaaataacatattggtgaagatgcggggaaaaaaaaagaactcttagacactgctggtgggaatgtaaactagagcagccatgtggagaacaacatggagtttcttcaaaaattacaaatagaactatcatatgatccagcaataccattactggaaaaaggaaatctgtatattaaagagacatttgaaccctatgtttactgcagcactattcacaatagccaagatataggagcaacctaggtgtccaacaacagatgaatggataaagaaaatgtggtatatatacacaatagaatactatgcagccataaaaaccgaattcctgtcattcaggacaacatggatggaattggagggcatatgttaagtgaaacaagccaggaacagaaagttaaacattgcatgttattacttatatgtggaagctaaaaaaattgatatcatagaagtaaaaaataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgaccactataaattatatgtattgaaacattattatgtatctcccaaatatgttcaattcttatgtcgctcaaaaaataaaatttaatttaaaaagtatctgatttttaaagtaaatattttttaaagttttgacatttaaattacttgaatctcattattttgacaataatttaattcttttattgttcaatctgttagtgagatgtgtcataggtattatgtcattagttcaaattcttgyggaaattatagctacattaaaagtgtaacatttttatttagttgtgtacttatttgttaataatacagacattgtatgttatcatactgcaatttacaattaaaatattttctgtagattatttgaaaatcattctgaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgtatgcacttgcaaagcaaaagtacattggtaatttgggcacattcagagtggaaaaaatttgttctatttttacatctttaaatacctatcttctatgaaagcctatgtgcatgtgtgtgtgtgtatgagtttctatgtgagcatgcatatatacttcacaaagagatgacctatataaatcaaagtacacattatttaaaatatttaaaagaaattttcagtttcttcatttttaaattgtgatttttagatttgttagtctatggagcattttcaattctcagattatacatatgtaataaaatatgttcat

SEQ ID NO: 357 - DNA, 2549 bp, Homo sapiens
atatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaragtgttctctatyggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggttatatmcaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgckggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacawagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcmccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtg

SEQ ID NO: 358 - DNA, 2373 bp, Homo sapiens
gcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgckggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacawagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcmccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtg

SEQ ID NO: 359 - DNA, 444 bp, Homo sapiens
tcccaatgattaacaatttatgtcgctaagacacaaaaaaatttaaaatacaaacaattcataaatgacaggatcctaatatagaaagtgtcttcattaaaattgatgtggtaggaaacactcatgttgtgctgtttatctgttttcctatgaatataatactgggaatattgttgaacaattcacagaaactctaaaaaatagaatgaatgcttcagtacaagatttttttaaatatttgttctaatttgattacagtttcacaatcttttgataagacttgtttcagctatgcaaaggaataaagaaatcacgaaactttttttttttgaaacagtcttgctccgtcgcccaggctggcatgcaccttggcaacagagtgagactccatctcaaaaaggataataaataaaaataaaataaaatatcaattattggtcaggc

SEQ ID NO: 360 - DNA, 716 bp, Homo sapiens
atgatcagatttgcaatgtgtagcatcattgacrttttactttcctttgaaaaaggaaacaatgcctgtttcccaagtccaaattataaccccttcacatggatgtttttcctggtttcatgtcctaactacacctatgagattggatcatggattagtttcacagtcatgacacaaacactgccagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaatctgattaaaaaatgaaaaagcgatctgaacagacatttcccaaaggaagacatatacatggtcaataagtatatttttaaaatg

SEQ ID NO: 361 - DNA, 2421 bp, Homo sapiens
ttgcatagaaaggctttattatgggttctgtctgtcacaaatagcatcaaatcaatcatctcagttctggaatatgagattcactacattaaattaatactttcattccaaaatagaaattcatattttaaaccactgaaattgatataaaccactgctttaatattgtaaacctaaatgtccaactataatgaccaacttatctaataatgaaaactgcagtagcagaactattaagcagatctttataattaacttatgaagactatttaacatagaaaaatatttatatgtaaaaaacacagacccaaattacatattctctataagtatatggttaaaaaacctgcaagaaaatatacctaaatgctaatgttcattgcattcagatgatagaattatggattttatccatagatttttcttctagattttatagtttttaaaaattatgatgccccttatatttatattgggaaatatacatttaaacaaactattatttggctaccatgctaatattcacaaccatgtggcactagcctaaaataaacttttcagaagaaactaaattattctatctaaatattctgggaaacgtttaagtgatattggaatctctatcaaaatttccacaccagagtgaagaaagacaaattagatgtgggatgaaagttgttctcactgataagtgagagctaaatgatgagaacacatggacacataaagggcaacaacacacactggggtctattggagggtggagggtaggaggagggagaggatcaggaaaaattactaatgggtactaggcttaacacctgggtgatgaaatcatctatacaacaaacccccatgacgtaagtttacctatgaaacaaactggcacatgtacccctgaacttaaaagttgttaaaaaaaaawtttttttaagagagatgaaagtgactcaagaagctgtgtcaccaaatctttgagagctatgtcaccaaatcaaaaaataacagaaaaccagacaagatcataagaaatcatttgcacaatcaagtggcatcattccaaaccactggaggagcaatgcccgctttctttttaaaattctcctgggaaaattactcctcagcctcctttataaatccttgaggaaatgtcaagttctttcargacaagaaaaactctcagctgggcacagtggctcacacctgtaatcccagcactttgggaagctgagactataatccctgctgggattacagatgtgagccaacatccctggccttaattcttttattatttaacaaaaattttttagagataagatctcttgtctgttgcccaagtgggagtgtagtggcgcaatcataactcactgcagcctcaaactactgggctcaatcaatcaccctgccttagcctccctagtagctgggactgtcggcccacacctggataattttttattttttgtagagatgaggtcttactatgttgcccaggctggtctcaaactcctggcctcaagcaatcctcctgcctggcctcccaaagtgctgggattacaggcttgagctaccacaccctgccatgactctttaattctgcatttttgtcagatactacaagtgatccttaggtactgtaaagcgtaaggaccattaaaattaaactattttaatatattttattacctcattaggctcagaaacaattaaaaatcttctttccccctaaaatactttaaaaacttgaaggtgttcctcaaggacaggaaagtaagatctggggccctcctattttaaattaaaaacccaaattatttgacccattcttctaagggtatatattgttcatacttcaagcatctgtcttcctctctaaagcctccctagtttcttcatctgtctacttaggagcaacttaaactagactataatctatcacagctcaaaaagaaaagagtacttactaaatgatcccaaattaaactcgtttaaaattaataagtcaaataaaattaataattccattcttcttagatagccagtaggaatagcagcttcttccaagcatgagagaatgggtgtgccttttatgcccaaatcaagaaataccaaaaaacaaacaaacaaacaaacaaaaaactgtcatgaattttagtatcttattaatttctaattagattttaacttctaattttggtaagtagttcaaaataacaacaacaacaamaaaaaaaaaaacacctgaaactagtggaaaaaacttccacagctttataataycgtagcattctttacacaaaagtcaattcctaaaccctcaaatttcagaacataaaaataaatttccatttacagatttcccccttccagttccaaaagtagttattctagagtaagtattcaacacataaaatttag

SEQ ID NO: 362 - DNA, 1074 bp, Homo sapiens
atgctggaggaccacgcggggtatgagctgcagattccagagctggtgatggtgcaggagggcctgtatgtcctgccctcacccagacacctgacatccaagtcccagcaactctggaatctggccatcctgcgaacctgctacgtgtcagcagcctggaaaagcagaaagtcactcatcttttcctggacatggggaactgtcatctcccwgggccctaggacccctcacttctcagagatcaccatcatcccacttccctggagycacggctccagtatcaccttcsaagtgactttcccaaggtttcatgtgaccacagagatgaccatccaactcaatgtctcctcacctgtagccttggagaatgccacctccctgtcagtcctgaakaaccaatccctgcgttttgtttatgtgactgacagcaacccacctgccaggctgagctggacctgggaaggccaagccctgaatctctcccagtygtcagaatcagccgtcctggagctgcccccagtggagtcttgtgatggaggggaatttgtctgccaagctcagcaccctttgggctcccagcatgtctccattagcctctctgtgcagagtgactccgttatctctatagaagaaggcgttttacagaccctgggtttcacactgattaggggaatcctcatggggaccagctgcacattcatctgtggattcacctggatctgctgcactaggaccttcggctcctcagtgctcacgatcaccccatggccccaggaccacagcaccaacctcacctggcaggtgaagttccctggagctggtgtgactacagagagaaccatccagctcagtgtctccwactccagactccgtttccagatgcctcctcatccagttcctccacagtctgagcagccgtgtttcctctctggtgctggagaacaaggggaaaatgccacagcctggaatggaggccttgcacagtctgttcctggccagactctccacccaaagtctctgcaggccaagccctctgtggctctgagactttgcgtgtgtaattccttctcctga

SEQ ID NO: 363 - DNA, 455 bp, Homo sapiens
atcagctgaccacgttgcctcttgtggtgtaaacttgtaccagttttacggtccctctggccagtacacccatgaatttgatggagaygagsagttctacgtggacctggrgaggaaggagactgyctggygktkgcctgagttcagcaaatttrgaggttttgacccgcagkktgcactgasaaacatsgctgtgrcaaaacacaacttgaacatcatgattaaacgctacaactctaccgctgctaccaatgaggttcctgaggtcacagtgttttccaagtctcccgtgacactgggtcagcccaacaycctcatytgtcttgtggacaacatctttcctcctgtggtcaacatcacatggctgagcaatgggcagtcagtcacagaaggtgtttctgagaccagcttcctctccaagagtgatcattccttcttcaagatcagttacctca

SEQ ID NO: 364 - DNA, 3834 bp, Homo sapiens
  misc_feature (1)...(3834): n = A,T,C or G, or insertion/deletion polymorphism (see Tables 1-2)
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcktggtgccccggggcrtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccmgcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagayggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcayagcttatctctcagccaacatcaccttctacaccggggtccygaaggcaganttcaagaaggagacgttcgacrtgacgctggagcccttgtccttcaagaaagaggcggtgcwgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacarttsagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggcyccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcagnagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagytctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattattattaattacaatgtaatagaagcttaaaataaagttaaactgattat

SEQ ID NO: 365 - DNA, 2044 bp, Homo sapiens
  misc_feature (1)...(2044): n = A,T,C or G, or insertion/deletion polymorphism (see Tables 1-2)
aagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagggatttctgacttcatggctgcctctgcctctaggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggaggtggtgctcagcttttatataaagggggaagcaagtatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatgggctttctcacttacgaagtgggtattgattctttgcaggatcctgtgtgcctggtcatagaggctagaaatcccattcgcaggttgcaaatgccagagcagcggtataggtggcatgtggactctccagaagaaatagcacatagatctcagttcatccccaggatctggcagcaactatgggcagagaatttcccccaaggagatgcagctgcttctgcaaaggctgccgntactgcagataaaggctcgttattcactgtgacacacctacatgtaccacctccatccatatttgctccagtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccmgcaagaattgttaccaattatttctctgcccatgataatgatgccaatttgcaaatggacatcttcctggaagaagatgggaacgtgaattccaaactcaccaaggattcagtgtgcaaggatctcaggagctattggcctcatacttacctccctccacaggctctggtcaaacacacccacctcaacctgtcttccccgctcctggttggtttgtggctggggcccctctcctctccaagtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggctggggactcaggaacctcagaagggcagagcagggcagag

SEQ ID NO: 366 - DNA, 5499 bp, Homo sapiens
gccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgattctcgctgaagtctgttaaytctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccracctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcracagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgarcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatyrcaaagtctccttttagtctagataatcattatttcattttaaaattagtgtttttcktagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtrtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttga

SEQ ID NO: 367 - DNA, 5289 bp, Homo sapiens
  misc_feature (1)...(5289): n = A,T,C or G, or insertion/deletion polymorphism (see Tables 1-2)
atacagaattcgttgttgggaaggactggggaaacagctgtaacatttgccaccctcagaagctgctggtcctgtgtcacaccaccttagcctcttgatngaggaagattctcgctgaagtctgttaaytctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccracctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcracagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgarcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatyrcaaagtctccttttagtctagataatcattatttcattttaaaattagtgtttttcktagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtrtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttga

SEQ ID NO: 368 - DNA, 5606 bp, Homo sapiens
  misc_feature (1)...(5606): n = A,T,C or G, or insertion/deletion polymorphism (see Tables 1-2)
gccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatngaggaagattctcgctgaagtctgttaaytctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccracctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcracagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgarcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatyrcaaagtctccttttagtctagataatcattatttcattttaaaattagtgtttttcktagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtrtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttga

SEQ ID NO: 369 - DNA, 5391 bp, Homo sapiens
ctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcgattctcgctgaagtctgttaaytctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccracctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcracagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgarcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatyrcaaagtctccttttagtctagataatcattatttcattttaaaattagtgtttttcktagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtrtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttga

SEQ ID NO: 370 - DNA, 2761 bp, Homo sapiens
  misc_feature (1)...(2761): n = A,T,C or G, or insertion/deletion polymorphism (see Tables 1-2)
ccagcccttagcaacggcctggcnacggtttccctgctgctgcagcccccgtcggctcctyttttccagtcctccactgccggggctgggcccggccgcgggaaggaccgaaggggatacagcgtgtccctgcggcggctgcaagaggactaagcatgnatggcagccggagagtcagagcaacctctgtccttcccagatatggtccaccgtgcctatttaaaggacacttgagcaccaaaagtaatgctgcagtagactgctcggttccagtaagcrtgagtaccagcataaagtatgcagaccaacaacgaagagagaaactcaaaaaggaattagcacratgtgaaaaagagttcaaattaactaaaactgcaatgcgagccaattataaaaataattccaagtcacttttkaataccttacaaaagccctcaggcgaaccgcaaattgaggatgacatgttaaaagaagaaatgaatggattttcatcctttgcaaggtcactagtaccctcttcagagagactacacctaagtctacataaatccartaaagtcatcacaaatggtcctgagaagaactccagttcctccccgtccagygtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacrgatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcgraggaaaactcggcaggcratcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatcaaggcgtatcacattgttgactcaatcttcatattctctccactgattaagaggactgcagataaagagcactgggtgccagtgaaccaaacccaaccacaaagggacagtgtgaccctgagcaagtcactacctctgtccactttctgatctacaaaatgaaatgacggagatactgagtcagctgtggcrttctactcactaccaaatcataatttataaacctcgttaaccctccccaaaacacttgtattctttatgttaaaacaagtccgaagcttatatgagataacataaaggaaatatttcggaaacataaatgttcctctctgtttaacacctccagaggcagctgtcctcggaacaaagttaaagtcactcacataaaaatcccttgaggtcttctggacagccatgttcaggccagtctgtgtattggaggtgccagacggtcctctcttgcccrgtaaggaggtgcttcatcttcaggcctgtggtggcatagcagccagagtctgtgcggaaccgggtcgtgatcttaaaccttccataggtgacagtgttgtgcctggaaccaagtcgtggccagtacctaaagctcttctcccttccaccctcctgttaaagatgagcatggttaaatgactcgagatccggcaatggatgcctttctcacatagacggcacatctgaaacagaaccacaaccctaccctgcctttttctccacaggtcaggattccagatgattaacattaactgttcttcagaggctgagaaaatcacttaagagaartaagtacctacctcttctgctgtcaccattgctataattgcaattccctgttcccataccatctgccaaaaatcttgacaggtattctgtaatggtccctgtgtggcaatataatcccattcgattccactgacagagacctgggattagaaaaggttaaaaaaattgatgtgtgggtataatatacataggtatgtatgcatgcattcatggtagtactaaaaaagtttttttaaaaaagtaaaaagtaaaaaagtagtaaactggattattcagcagaataaggaaagacttttcatcttttcccttgtgaatacaatttgcattactgacatttttataaacttaggtactgtgaatatacataatatctatgcaacctgtttaaccttgctgaatgtcagttctcatttatacaataaagatactgcctaccgtcat

SEQ ID NO: 371 - DNA, 2009 bp, Homo sapiens
  misc_feature (1)...(2009): n = A,T,C or G, or insertion/deletion polymorphism (see Tables 1-2)
tgggcccttagcaacggcctggcgacggtttccctgctgctgcagcccccgtcggctcctcttttccagtcctccactgccggggctgggcccggccgcgggaaggaccgaaggggatacagcgtgtccctgcggcggctgcaagaggactaagcatgnatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcrtgagtaccagcataaagtatgcagaccaacaacgaagagagaaactcaaaaaggaattagcacratgtgaaaaagagttcaaattaactaaaactgcaatgcgagccaattataaaaataattccaagtcacttttkaataccttacaaaagccctcaggcgaaccgcaaattgaggatgacatgttaaaagaagaaatgaatggattttcatcctttgcaaggtcactagtaccctcttcagagagactacacctaagtctacataaatccartaaagtcatcacaaatggccctgagaagaactccagttcctccccgtccagygtggattatgcagcctcgggcccccggaaactgagctctggagccctgtatggcagaaggcccagaagcacattcccaaattcccaccggtttcagttagtcacttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacrgatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaacaaaaaaaaaaaaaaaaaaaa

SEQ ID NO: 372 - DNA, 1439 bp, Homo sapiens
gctactcctcccccragagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctyacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgccyggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggaygtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgyccggccctcttcccctcgggcgttcctgcggcccggagcagcccagcgcagcccaggctttgccaacggctcgacgggtttgacagctgtggaggtgagaatccacttcyggta

SEQ ID NO: 373 - DNA, 2644 bp, Homo sapiens
gctactcctcccccragagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctyacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgccyggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggaygtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgyccggccctcttcccctcgggcgttcctgcggcccggagcagcccagcgcagcccaggctttgccaacggctcgacggggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccagstgccgtggagcagcaggctggctttggtaggggcacccatcacccggcttgcctgtgcagtcagtgagtgcttagggcaaagagagctcccctggttccattccttytgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggccccctttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagttac

SEQ ID NO: 374 - DNA, 2306 bp, Homo sapiens
gctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccaccmggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctktaatcactaccattgtaacttggatgtagccatgaccttmcatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgttt

SEQ ID NO: 375 - DNA, 5671 bp, Homo sapiens
attaggctgcagaaaggaatctcctgagggagttattctgaagaagggaagttcctctggtctggtgtctactagaattgcttttccttgaaactctgccttcttctggaaggcagaaatctaacatgattcaatggctacagctgtggaagtgtgcagaggaaagcattagaccagggttctcatccctggcttgcacacccagagcctggcctgcacacctagagcctggacccaaaaacaacaaaaaagtgatggaactggatgctctcccagtcttacatttctatgtaaatgtgaaagagaaacatggctacaaggaccaggtttgaaatttttcactataaraagtttttgaaaataaggagccccagagagaattcctagaagatggcagaggaggaaaaagaggaacctatcttcccacctagataataattttaccagtagaatctgtctaatgattttctcctctggatttgctctggcacctcgaagaagcttaggggaacagttcagctttgctcttcctgataattagtggctttcctgatggtgtggttcaacacacccaccagagacggaagatgtaaacaacatgtgtgctccagatggactctgaaatccaggctcccactttatgacacactcctctacaacaccagagactcccaaacacaaggccttatattgactcatttcagctcacatcctggcgactctcaagagagaaacctcagagtgactaaaatctccataatgagaagacatgtacattcagtatctattttggcattttccccaatacatctctgctcatctgactcttatcttggcatctgcttcctggtggatctgaactgacccataagccacgcttactrgtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccaccmggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctktaatcactaccattgtaacttggatgtagccatgaccttmcatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgttttttgtttttgagatcgagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcyaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcrctctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagtaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaayttggttgaaaagctctctgcagaagaagtgatctagactgacagaagtgttgctaattacaagttgtgttctcatgacgtaattagaaagtaacttctcaaagtacaacttttatgaaaaarataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 376 - DNA, 5024 bp, Homo sapiens
gctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccaccmggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctktaatcactaccattgtaacttggatgtagccatgaccttmcatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgttttttgtttttgagatcgagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcyaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcrctctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagtaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaayttggttgaaaagctctctgcagaagaagtgatctagactgacagaagtgttgctaattacaagttgtgttctcatgacgtaattagaaagtaacttctcaaagtacaacttttatgaaaaarataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 377 - DNA, 5206 bp, Homo sapiens
  misc_feature (1)...(5206): n = A,T,C or G, or insertion/deletion polymorphism (see Tables 1-2)
gggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagkgggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatgaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgttkccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcnggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacytaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcaytcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagcsagggctgagcagtgggccatctgtcgctggaaaaatgtctcttccttcctaggcctacctctgttggtgcttttgtcttccaacctccctatgtagtaagaccagccaagcccacatgcccactgggagccctgaaaccasatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaakaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaraaaagaaaagaaaagaaagaaaactcagctaggaattagaaacatcatttgtcctcttggcctgttcagctggtgactgtag

SEQ ID NO: 378 - DNA, 6939 bp, Homo sapiens
  misc_feature (1)...(6939): n = A,T,C or G, or insertion/deletion polymorphism (see Tables 1-2)
gggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagkgggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgttkccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcnggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacytaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaatgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcaytcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagcsagggctgagcagtgggccatctgtcgctggaaaaatgtctcttccttcctaggcctacctctgttggtgcttttgtcttccaacctccctatgtagtaagaccagccaagcccacatgcccactgggagccctgaaaccasatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaakaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaraaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 379 - DNA, 6922 bp, Homo sapiens
ctctctctctctgagatagcagacaccagagtgaaactggtgcagcttcctttgagaagcgtgcttgcatgtgcggattggcaggattgtgtgagctcctctcccatccatgcactgttcttggagggaaatgcaatgttggagcaggggctgagctgcactgggaaggtggctgggagctcagtgaggccaggatcatggtttagccaaaggctggaatcacaagaatgtttcaccagggtctgctctgagagttctcagacccccatggattttagaattttccagcctttcctccttcaccttcgcacaattttactttctcctgagatggccccagatctgcaagagacatttgagagaagctatttattagcagacgtgaagaaatggattctgcacttgattatttagccatgacttatcaatgatgatggattggaaagcagtagctgcccagaagttaaatctgtcttctaaaaagaagaaacatcggccttccacttcttccsctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagstcataaacgaacgcaaggaaaagaccggcgcccgtttctcmgtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagygggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccrgccygcagaggcaggagaggcygcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgaagccccagcctccagagcagccgggagagcctcaactcctgcggcttcgtggaaggcaagcccaggcccatgggctccccccggctgggcatcgccagcctgtccaagacctcrgagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctytgcacgggccctggcctcgggctcgcggcccgtcagcatcatcagcagcatcagygaggacctggagtgctactccagcacggcccccgtctccgaggtcagcatcacacagttcttgcccctcccgaagatgagcctggatgagaaggcccaggaygcagggagcagacgctcttccatcagctcctggctgagcgagatgagcgcgggcagtgaggcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccsgaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacggtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatygatgaygtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggygaccaaacagtatctgatgctggatcccaacaagtggctcagtgaatttgacttggagcaggtttgggagctggattccctggagtacctggaggcaytggagtgtgtgacggagcgcctggagagccrtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagasacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatggg

SEQ ID NO: 380 - DNA, 3480 bp, Homo sapiens
ttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacggtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatygatgaygtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggygaccaaacagtatctgatgctggatcccaacaagtggctcagtgaatttgacttggagcaggtttgggagctggattccctggagtacctggaggcaytggagtgtgtgacggagcgcctggagagccrtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagasacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatggg

SEQ ID NO: 381 - DNA, 3635 bp, Homo sapiens
gctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacggtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatygatgaygtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggygaccaaacagtatctgatgctggatcccaacaagtggctcagtgaatttgacttggagcaggtttgggagctggattccctggagtacctggaggcaytggagtgtgtgacggagcgcctggagagccrtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagasacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatggg

SEQ ID NO: 382 - DNA, 1129 bp, Homo sapiens
  misc_feature (1)...(1129): n = A,T,C or G, or insertion/deletion polymorphism (see Tables 1-2)
cggaaggtggcgcggccaccagtaacatgatctctagactgggacggtggggttcctgccggctgtattcgggccttggactggactgagaagctacggtggagaccatccatggaaaagaacccccctgatgatacggsccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatyctgcctcgtcatccagttggttcaagagcaaaccaaagancccagtaagaaccctcttctcgggaagaaacgggccctgctgctgtctgagccttygctccttcgaaccgtgcagcagatcccaggagttggaaaagttaaagctccccttctcctccagaagtttccaagcatccagcaactgagtaatgcttccaytggggaactggagcaggtggtcggacaagcagtggcacagcagatccatgccttcttcacrcagcccaggtgagggctggcctcagggccacggcatcttctccygagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaac

SEQ ID NO: 383 - DNA, 3061 bp, Homo sapiens
  misc_feature (1)...(3061): n = A,T,C or G, or insertion/deletion polymorphism (see Tables 1-2)
aaaacatagtatatacagggtttggtatttctgaggtttcaggcatccattaggggtcctggaatgtatcctgcaaggataaggagggactatagtatgctatttaactttcttttagtaatatgagttgcaagtaaaaattcctggtatagtattattattacaacaagacagtctatgcctgttgaaactggcactttttctttcccaaaactaattttattctttaaggggcatgctatcttgaaaaggagggcaaatagagctgcctgtgaaaaggaataatataaaacggagacccggccgccgtgatgctgtcccggtcccactgtgtcccgggcgttcagccactcgctctctgccttccagaaggggaactgccctctagggagacattccctgcctggggtctccttatgccagggaccaggttaccctaacagcaggaaggttgtcattaacaacagtgtcttcagtgttcgcttcttcagaactacaactgtatgcaagtatgacttggttacagtcaaaaccccagcgtttgcagaacctgtcacagagggagatgtcaggtgggagaaagctgttggagacacagttgcagaagatgaagtggtttgtgagattgaaactgacaagacattggtgcaggttccatcaccagcaaatggcatgattgaagctcttttcgtacctgatgggggaaaagtcgaaggaggcactccgcttttcacactcaggaaaactggtgctgctcctgctaaggccaagccggctgaagctcctgctgctgcagccccaaaagcagaacctatagcagcggcagttcctccccntgcagcacccatacccactcgatgccaccagtgccctcgccctcacaacctccttctagcaaacctgtgtctgcagtaaaacccactgctgtcccaccactagctgagccaggagctggcaaaggtctgcattcagaacatcnggagaaaatgaacaggatgcggcartgcattgctcagcgtctgaaggaggcccagaatacatgtgccaatgctgacaatttttaatgagattgatgtgagtaacatccagaagatgagggctcggcacaaagaggcttttttgaagaaacataacctcaaactaggcttcatgtcggcatctgtgaaggcctcagcctttgccttgcaggaacagcctgttgtaaacgcagtgattgatgatataaccaaagaggtggtatatagggattatattgacatcagtgttgcagtggccaccccacagggtctggtggttccagtcatcaggaatgtggaagctatgaattatgcagatattgaacagaccatcactgaactgggagagaaggcccgaaagaatgaatttgccattgaagatatggatggtggtaccttcaccattagcaatggaggtgtttttggctcactctttgaacacccattatcaacccccctgtctgccatcctggggatgcatggcatctttgacaagccagtggctataggaggcaaggtagaggtgcagcccatgatgtacgtggcactgacctatgatcaccggctgattgatggcagagaggctgtgactttcctccgcaaaatcaaggcagcggtagaggatcccagagtcctcctctttgatctttaggaggaacccacacaccctacaaattgatcatgcaggaactgaaaaccagtcttctccctgtcccctcatgggtcccaggttagcctggtgacaggcacatgctgttggcctcamgcaaggaagcagagcactatgtaaccagcagtcacagcttttttcttggtgttcctgcctggctctctccctctctgcacctgtctcataccctcgaatatcttaattccttaggcttgagagagagccttaatggatgctcattcatattcctgcctttcttccatcagctctctgcaaagatgattttgcttctccctagtgctggtatactatagagaaacccccgaggaccatgtgattaagttcctatcttttgaaagtttgttctgcagagacatctaggaggatgctgtgcctcccaagctcagagcagcctctgtcctggctgtgcacattctcgattccacttgtatggagggattgaacacaggcaaagaggtgctgctttccttcttcaatggcaccttcattctccattgtcattgacttcaagatgcctcttctacctctaccaggaagcacaggccaggggatctgggtgtgtgaatgggagganagagcagaggttccctgaggtcacgtgttgtaatcatcatagaaggagagcccaggtctgccctcacgctctccatcataggctcacaccaagaagactcatcttggcacaatctcacacagctggggctgtagcaaccctttcctggttgctgggcctcattctagcaccttgttcttacttagagcagattctagcacatcatggcagtggaaccaagcgtagtcccgaagaagggccagagcctggtagagattagggaagggaggtctcctctagactcagattgccttgagcttttcaagtaagttgctgtaagcccgtgggctgaggaggcagttcttgttccttcctgcgttatagtggggccttgtctcttcctctgcaggacacagatttggaggacgtggactggggtaggaaaccaccctgagggtgttagtagatagtggtgtaatggatgaggtcatttctaagatgtgttgccggtggatctgggcacaatcattggaattccttggagctactgggattcatggctttgtatccaactgcatccaggccwgaggctgctgacatttgacactagggccagtagagagtgcctttttgtatcttgagccaagaagtgaggcctgggggtggggaggggggaaggggtgggagccaatactgagtgcctgcagcatctactactctgtcttcactattcagaacttgtaactaaagtatttaaagaaactgattttaaatgcaaattaaagggcagatgttctcaaa

SEQ ID NO: 384 - DNA, 2676 bp, Homo sapiens
  misc_feature (1)...(2676): n = A,T,C or G, or insertion/deletion polymorphism (see Tables 1-2)
aaccgcatctgcagcgagcawctgagaagccaagactgagccggcggccgcggcgcagcgaacgagcagtgaccgtgctcctacccagctctgctncacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacrgtcactgccatctcgaccagtccggacctgcagtggctggtgcagcccgccctcgtctcctcygtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggstctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgctcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattcycagatatttatatttttattttatttttttctaccttgaggtcttttgacatgtggaaagtgaatttgaatgaaaaatttaagcattgtttgcttattgttccaagacattgtcaataaaag

SEQ ID NO: 385 - DNA, 2108 bp, Homo sapiens
  misc_feature (1)...(2108): n = A,T,C or G, or insertion/deletion polymorphism (see Tables 1-2)
aaccgcatctgcagcgagcawctgagaagccaagactgagccggcggccgcggcgcagcgaacgagcagtgaccgtgctcctacccagctctgctncacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacrgtcactgccatctcgaccagtccggacctgcagtggctggtgcagcccgccctcgtctcctcygtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggstctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattcycagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaa

SEQ ID NO: 386 - DNA, 2032 bp, Homo sapiens
  misc_feature (1)...(2032): n = A,T,C or G, or insertion/deletion polymorphism (see Tables 1-2)
aaccgcatctgcagcgagcawctgagaagccaagactgagccggcggccgcggcgcagcgaacgagcagtgaccgtgctcctacccagctctgctncacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacrgtcactgccatctcgaccagtccggacctgcagtggctggtgcagcccgccctcgtctcctcygtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggstctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgctcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattcycagatatttatatttttattttatttttttctaccttgaggtcttttgacatgtggaaagtgaatttgaatgaaaaatttaagcattgtttgcttattgttccaagacattgtcaataaaag

SEQ ID NO: 387 - DNA, 1755 bp, Homo sapiens
  misc_feature (1)...(1755): n = A,T,C or G, or insertion/deletion polymorphism (see Tables 1-2)
attacacattcaaagtatccatttgttctcaagaggtagcaagaaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggagractggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgatggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaatccta

SEQ ID NO: 388 - DNA, 1998 bp, Homo sapiens
  misc_feature (1)...(1998): n = A,T,C or G, or insertion/deletion polymorphism (see Tables 1-2)
aaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggaggatatcaaagtcgtcttgtgcagaagtgaagagtttcagtttctcaacccaacccctgttcctctrgaactggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 389 - DNA, 1312 bp, Homo sapiens
  misc_feature (1)...(1312): n = A,T,C or G, or insertion/deletion polymorphism (see Tables 1-2)
attacacattcaaagtatccatttgttctcaagaggtagcaagaaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggagractggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggtaagagtcctgtctctgaatactaagggacctctaagtctacaggtggtcaaaatgctgtatccacccaattccactaaatggaataaatgaataaatgaatgaattcatttattccrtttcctcagttcctccccaaattacacctctgccaggaaacagagggcgctccgacttgttcaggtgtactttcttgagtttcacctccatccctcctgctgtatgtaga

SEQ ID NO: 390 - DNA, 1931 bp, Homo sapiens
  misc_feature (1)...(1931): n = A,T,C or G, or insertion/deletion polymorphism (see Tables 1-2)
aaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggagractggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 391 - DNA, 1822 bp, Homo sapiens
  misc_feature (1)...(1822): n = A,T,C or G, or insertion/deletion polymorphism (see Tables 1-2)
attacacattcaaagtatccatttgttctcaagaggtagcaagaaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggaggatatcaaagtcgtcttgtgcagaagtgaagagtttcagtttctcaacccaacccctgttcctctrgaactggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgatggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaatccta

SEQ ID NO: 392 - DNA, 2041 bp, Homo sapiens
  misc_feature (1)...(2041): n = A,T,C or G, or insertion/deletion polymorphism (see Tables 1-2)
attacacattcaaagtatccatttgttctcaagaggtagcaagaaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggaggatatcaaagtcgtcttgtgcagaagtgaagagtttcagtttctcaacccaacccctgttcctctrgaactggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 393 - DNA, 1974 bp, Homo sapiens
  misc_feature (1)...(1974): n = A,T,C or G, or insertion/deletion polymorphism (see Tables 1-2)
attacacattcaaagtatccatttgttctcaagaggtagcaagaaacagtatccacagtggactcyggggctcctacagacttggcacagyttcctacagtcttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattcccygaagaccaagcagaacatgccacccaggcagctgctggagractggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtgg

SEQ ID NO: 394 - DNA, 2050 bp, Homo sapiens
  misc_feature (1)...(2050): n = A,T,C or G, or insertion/deletion polymorphism (see Tables 1-2)
tctagaggatccgccaagaggtagcaagaaacagtatccacagtggactccggggctcctacagacttggcacagcttcctacagycttgaaacagccctgttgttctgtcatggccagtgggcagtttgtgaacaaactgcaagaggaagtgatctgccscatctgcctggacattctgcagaaacctgtcaccatygactgtgggcacaatttctgcctcaaatgcatcactcagattggggaaacatcatgtggatttttcaaatgtcccctctgcaaaacttccgtaagaagagacgcaatcaggttcaactcgctgttgyggaatctggtggagaaaatccaagctctacaagcctctgaggtgcagtccaaaaggaaagaggctacatgcccgaggcaccaggagatrttccaytatttctgcgargatgatgggaagttcctctgttttgtgtgtygtgaatccaaggaccacaaatcccatratgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcnttgattccctgaagaccaagcagaacatgccacccaggcagctgctggagratatcaaagtcgtcttgtgcagaagtgaagagtttcagtttctcaacccaacccctgttcctctggaactggagaaaaaactcagtgaagcaaaatcaagacaygactccatcrcagggagcctraaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggmagaactacatcgggrccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggytgacagcgatccgggcttggttttgtraggttccttcaagctaagccagytcagagaacacggggagcggtggtgctmcacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccrgagasgagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaaaaaaaaaaaaaaa

SEQ ID NO: 395 - DNA, 4740 bp, Homo sapiens
  misc_feature (1)...(4740): n = A,T,C or G, or insertion/deletion polymorphism (see Tables 1-2)
ttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctyccctcgccgtggctggaattggactggtgttggacatcatcctcttcgtgctctgcaaaaaggggctgctcccggaccgggtcacccgcagagtgctgccctaygtgctgtggctgctcataaccgcccagatcttctcctacctgggcctgaacttcgcgcgtgcccacgcggctagtgacacggtgggctggcaggtcttctttgtcttctcctycttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttytgcctgcagtgcccaggagcttgtgaagctgctcaacgagctctttgcccgctttgacaagctggcagctaaataccaccagctgcggattaagatcctgggcgactgctactactgcatctgcggcttgccygactaccgggaggaccacgccgtctgctccatcctsatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcngattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctstgygtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagsgcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagc

SEQ ID NO: 396 - DNA, 4902 bp, Homo sapiens
  misc_feature (1)...(4902): n = A,T,C or G, or insertion/deletion polymorphism (see Tables 1-2)
gatcccgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctyccctcgccgtggctggaattggactggtgttggacatcatcctcttcgtgctctgcaaaaaggggctgctcccggaccgggtcacccgcagagtgctgccctaygtgctgtggctgctcataaccgcccagatcttctcctacctgggcctgaacttcgcgcgtgcccacgcggctagtgacacggtgggctggcaggtcttctttgtcttctcctycttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttytgcctgcagtgcccaggagcttgtgaagctgctcaacgagctctttgcccgctttgacaagctggcagctaaataccaccagctgcggattaagatcctgggcgactgctactactgcatctgcggcttgccygactaccgggaggaccacgccgtctgctccatcctsatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcngattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctstgygtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagsgcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagc

SEQ ID NO: 397 - DNA, 5548 bp, Homo sapiens
  misc_feature (1)...(5548): n = A,T,C or G, or insertion/deletion polymorphism (see Tables 1-2)
gatcccgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctyccctcgccgtggctggaattggactggtgttggacatcatcctcttcgtgctctgcaaaaaggggctgctcccggaccgggtcacccgcagagtgctgccctaygtgctgtggctgctcataaccgcccagatcttctcctacctgggcctgaacttcgcgcgtgcccacgcggctagtgacacggtgggctggcaggtcttctttgtcttctcctycttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttytgcctgcagtgcccaggagcttgtgaagctgctcaacgagctctttgcccgctttgacaagctggcagctaaataccaccagctgcggattaagatcctgggcgactgctactactgcatctgcggcttgccygactaccgggaggaccacgccgtctgctccatcctsatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcngattttgactctgtgagtgcccatcccaccctgcactctggccatgaagcyggcccattccacatcacatcctacaataggctgcagaggccagagaaactggcttcattttcccagataagccccttccgcaatacatggacttctgcagccacctggaactgctgggctggggaaggggaggtgaggtgggagcccgggaaatcacccacagggtcacaggataaggataaggactggccaagcaacatctcgagacctctctgtcctgggactgtctcctcaaattcagagccggtcagcattgactgggtgacctgtataccagggagaatgcttttacacacgcgcggagcccccctaggagactgccgattttatgtcagtgttgaggttgtggaaacaggcccagaaagttaggaagttctcccaggatcatgtggcagataagcggtagactaagtaacaactttgataggaaagtgtctcttgggtttagtggggtccttgtaaacaggtacatctgtcactgggttgggtcattcctctcccttgactgctgacaattctttcctgaatcctggcctcagctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcagtggcgtctggcagaaaagctccacgaaaggggcaaagggacagaagagcaggcagtggcagtttccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctstgygtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagsgcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagc

SEQ ID NO: 398 - DNA, 4970 bp, Homo sapiens
  misc_feature (1)...(4970): n = A,T,C or G, or insertion/deletion polymorphism (see Tables 1-2)
gatcccgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggctyccctcgccgtggctggaattggactggtgttggacatcatcctcttcgtgctctgcaaaaaggggctgctcccggaccgggtcacccgcagagtgctgccctaygtgctgtggctgctcataaccgcccagatcttctcctacctgggcctgaacttcgcgcgtgcccacgcggctagtgacacggtgggctggcaggtcttctttgtcttctcctycttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttytgcctgcagtgcccaggagcttgtgaagctgctcaacgagctctttgcccgctttgacaagctggcagctaaataccaccagctgcggattaagatcctgggcgactgctactactgcatctgcggcttgccygactaccgggaggaccacgccgtctgctccatcctsatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcngattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcagtggcgtctggcagaaaagctccacgaaaggggcaaagggacagaagagcaggcagtggcagtttccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctstgygtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagsgcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagc

SEQ ID NO: 399 - DNA, 1698 bp, Homo sapiens
atggcagcggggttcgggcgatgctgcaggtgttctttacaggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctacyaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtrgaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaarccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacacttaatggtattattaaagttctttttattgcagtttggaaagcatttgtgaaacttt

SEQ ID NO: 400 - DNA, 3560 bp, Homo sapiens
ctgcaggcacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttacttaccaccwccactttgaaggctttcttgcctataccaggacaaactcagctctttatcccttttccgaattttcctggtactttcactttgaataragcgcttaattaacattctgccttgtacctaggactaacacastataaattcccagaagacaaagtaggggaatacaataacaggatatagaattttaacagctaaattagatgaatttatgggtgacctttattgggcaaaagaaaatgttaagttagtataagatttagtataagctaccatctcaaaactcagggtctcactggaagagaaagtgactccaggtagaattcctcagggagacattcacttccatcattcgctgaaccaggagctttggacagcctcggattgcaccsgcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccgttctctccgggtaaaggtgaaggctgaccacgggggccgctctccctccaggccccagccacgccctctaacccaggttcccgtcctgcaccgcgccgcaagtccccccaccgttcagcgcaaccgggccctcccagccccgccgccgtccccctcccccgcccyggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgyattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagagaggaaatcatcccagtggctgcagaatatgataaaactggtgaatatccagtccccctaattagaagagcctgggaacttggtttaatgaacacacacattccagagaactgtggaggtcttggacttggaacttttgatgcttgtttaattagtgaagaattggcttatggatgtacaggggttcagactgctattgaaggaaattctttggggcaaatgcctattattattgctggaaatgatcaacaaaagaagaagtatttggggagaatgactgaggagccattgatgtgtgcttattgtgtaacagaacctggagcaggctctgatgtagctggtataaagaccaaagcagaaaagaaaggagatgagtatattattaatggtcagaagatgtggataaccaacggaggaaaagctaattggtattttttattggcacgttctgatccagatcctaaagctcctgctaataaagcctttactggattcattgtggaagcagataccccaggaattcagattgggagaaaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtagctgctggtgctgttggattagcacaaagagctttggatgaagctacyaagtatgccctggaaaggaaaactttcggaaagctacttgtagagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtrgaaaaactaatgagggatgccaaaatctatcagatttatgaaggtacttcacaaattcaaagacttattgtagcccgtgaacacattgacaagtacaaaaattaaaaaaattactgtagaaatattgaataactagaacacaarccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttwattctgagcccatatttcacttaccttatttaaaataaatcaataaagcttgccttaaattatttttatatgactgttggtctctaggtagcctttggtctattgtacacaayctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacytcagaaaatataaatatgaaataatt

SEQ ID NO: 401 - DNA, 10944 bp, Homo sapiens
  misc_feature (1)...(10944): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctatt

SEQ ID NO: 402 - DNA, 10827 bp, Homo sapiens
  misc_feature (1)...(10827): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctatt

SEQ ID NO: 403 - DNA, 10842 bp, Homo sapiens
  misc_feature (1)...(10842): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctatt

SEQ ID NO: 404 - DNA, 11445 bp, Homo sapiens
  misc_feature (1)...(11445): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctatt

SEQ ID NO: 405 - DNA, 10250 bp, Homo sapiens
  misc_feature (1)...(10250): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctaatgtaaagtctagaaaataatgcaaatgtcacggctactctatatacttttgcttggttcattttttttcccttttagttaagcatgactttagatgggaagcctgtgtatc

SEQ ID NO: 406 - DNA, 9632 bp, Homo sapiens
  misc_feature (1)...(9632): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctaatgtaaagtctagaaaataatgcaaatgtcacggctactctatatacttttgcttggttcattttttttcccttttagttaagcatgactttagatgggaagcctgtgtatc

SEQ ID NO: 407 - DNA, 9650 bp, Homo sapiens
  misc_feature (1)...(9650): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctaatgtaaagtctagaaaataatgcaaatgtcacggctactctatatacttttgcttggttcattttttttcccttttagttaagcatgactttagatgggaagcctgtgtatc

SEQ ID NO: 408 - DNA, 10845 bp, Homo sapiens
  misc_feature (1)...(10845): n = A,T,C or G, or insertion/deletion polymorphism (see Tables 1-2)
cgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattycctggatacccaggaccaaagggtaacccaggtgarcctgggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctatt

SEQ ID NO: 409 - DNA, 4265 bp, Homo sapiens
  misc_feature (1)...(4265): n = A,T,C or G, or insertion/deletion polymorphism (see Tables 1-2)
attttgyctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcnctantgctgcgcactgctttttctacaggcattacatcaactcctaaggggtcctctgggattagttawgcagntattaaatcacccgaagacactaanttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtntgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatntaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 410 - DNA, 4047 bp, Homo sapiens
  misc_feature (1)...(4047): n = A,T,C or G, or insertion/deletion polymorphism (see Tables 1-2)
acctgctccgtggagcgcctgaaacaccagtctttggatggagtctcgttctgttgcccaggctggagtgcagtggcacaatctcggctcacttcaacctccgtctcccaggttcaagcaattstcctgtctcagcctcctgagtagctgggactacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcnctantgctgcgcactgctttttctacaggcattacatcaactcctaaggggtcctctgggattagttawgcagntattaaatcacccgaagacactaanttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtntgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatntaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 411 - DNA, 4391 bp, Homo sapiens
  misc_feature (1)...(4391): n = A,T,C or G, or insertion/deletion polymorphism (see Tables 1-2)
attttgyctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagrcatttctaaaatcgcacccagaactgtctacaccaagagcaaakattcgactgtcaatcacacttwgacttgcaccaaaataccacctatgaactatgtgtcaaagagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcnctantgctgcgcactgctttttctacaggcattacatcaactcctaaggggtcctctgggattagttawgcagntattaaatcacccgaagacactaanttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtntgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatntaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 412 - DNA, 4299 bp, Homo sapiens
  misc_feature (1)...(4299): n = A,T,C or G, or insertion/deletion polymorphism (see Tables 1-2)
tggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttgcagactgtctctcccctcstgggatttacagggtcatggctctgaaacattcngkagtgttctttggacacgagttttccctggagatcgctttctgcaggcctcttggtcctgactgtgscttcttttcagagsctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcnctantgctgcgcactgctttttctacaggcattacatcaactcctaaggggtcctctgggattagttawgcagntattaaatcacccgaagacactaanttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtntgagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatntaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 413 - DNA, 2593 bp, Homo sapiens
  misc_feature (1)...(2593): n = A,T,C or G, or insertion/deletion polymorphism (see Tables 1-2)
tggacttggatccgaggcagacgaggaagctgagaaaaccctggcgttgaccccgtggacctgggcgccccgggaaggtccagcgcttggtccaggcaggcggggatgtgcggtgaccaccctggtcctgaaaagtccagccccgaatctccctccctcctagacctggaggcctggaacagccagccgcccacggacgccagagccgggaaccctgacggcacttagctgctgacaaacaacctgctccgtggacgcctgaaacaccagtctttggggccagtgcctcagtttcaatccaggtaacctttaaatgaaacttgcctaaaatcttaggtcatacacagaagagkctccaatcgacaagaagctggaaaagaatgatgttgtccttaaacaacctacagaatatcatctataacccggtaatcccgtwtgttggcaccattccygatcagctggatcctggaactttgattgtgataygtgggcatgttcctagtgacgcagacagattccaggtggatctgcagaatggcagcagyrtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctraaggmcaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcagactgtctctccctcctgggatttacagggtcatggctctgaaacattctgtagtgttctttggacacgagttttcctggagatcgctttctgcaggcctattggtctgactgtggcstcttttcagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattagrtcctgctgggtgttctcagtccttgccatgamgtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcnctantgctgcgcactgctttttctacaggcattacatcaactcctaaggggtcctctgggattagttawgcagntattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgaycacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaaaaaaaaaaaaaaaaaaaaaaaaaaaaaaaaaa

SEQ ID NO: 414 - DNA, 6274 bp, Homo sapiens
  misc_feature (1)...(6274): n = A,T,C or G, or insertion/deletion polymorphism (see Tables 1-2)
gttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggargcacccagaatccagaygagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtyacaactccagacyctcagtgatgcccacagaaaagcctatgagatttaccacgaaagctatgcttttcagggcggaaaactctctrttgtcctgcgagctgaagatatcccggagctcctgctagaaccacccatatctgcgcttgcccaggacacggtsgatttcctctctcttgatttgtcttatgaatgccaaaatgaggcaagtctgcggcagaagctgagtaaattgcagaccattgagccaaaagtgaaagttttcatcttcaacctaaaactcccagactgcccctccaccatgaagaacccagccagtctgctcttcagcctttttgaagccataaataaagaccaagtgctcaccattgggtttgatattaatgagtttctgagttgttcatcaagttccaagaaaagcatgtcttgttctctgactggcagcctggcccttcagcctgaccagcagcaggaccacgagaccacggactcctctcctgcctctgcctatcagagantctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacrtcgccctgctttgcggcctccgggctcaggtgtacaagttctccatctcctggtcccggatcttccccatggggcacgggagcagccccagcctcccaggngttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgacyttccatgagccgtgggtgatgagctacgcaggstatggcaccggccagcaccctcccggcatctctgacccaggagtggcctcttttaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggygtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgytgaatgagccctttgtcattgcttaccagggctatggctacggaacagcagctccaggagtctccaataggcctggcactgccccctacattgttggccacaatctaataaaggctcatgctgaggcctggcatctgtacaacgatgtgtaccgcgccagtcaaggtggcrtgatttccatcaccatcagcagtgactgggctgaacccagagatccctctaaccaggaggatgtggaggcagccaggagatatgttcagttcatgggaggctggtttgcacatcctattttcaagaatggagattacantgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccagatgcyggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatstttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttc

SEQ ID NO: 415 - DNA, 2715 bp, Homo sapiens
attaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtktcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgaygacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgcygcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatckccaagccccscatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtaygccaactga

SEQ ID NO: 416 - DNA, 1719 bp, Homo sapiens
gttgacagcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacrgttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgasgaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggcccgagc

SEQ ID NO: 417 - DNA, 1447 bp, Homo sapiens
gaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacrgttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgasgaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagta

SEQ ID NO: 418 - DNA, 1770 bp, Homo sapiens
tcctcccacctcggcctcccaaaatgctgggaatacaagcatgagccatggcatgtggcygccacttgccttttttcattaagagtctataattggagatcttacagggaactgggctttctgctcagccatactygagctcatttgacccccggccactgccccttgaratcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacrgttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgasgaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggcccgagc

SEQ ID NO: 419 - DNA, 1606 bp, Homo sapiens
gttgacagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacrgttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgasgaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggcccgagc

SEQ ID NO: 420 - DNA, 1027 bp, Homo sapiens
  misc_feature (1)...(1027): n = A,T,C or G, or insertion/deletion polymorphism (see Tables 1-2)
atgggggtcatggctccccgaaccctcctcctgctgctcttgggggccctggccctgaccgagacctgggccggctcccactccttgaggtatttcagcaccgcagtgtcccagcccggccgcggggagccccggttcatcgccgtgggctacgtggacgacacagagttcgtgcggttcgacagcgactccgtgagtccgaggatggagcggcgggcgccgtgggtggagcaggaggggctggagtattgggaccaggagacacggaacgccaagggccacgcgcagatttaccgagtgaacctgcggaccctgctccgctattacaaccagagcgaggccggccatggttctcacaccatccagaggaagcatgrctgcgacgtgggcccgacaggcgcctcctccgcaggtatgaacagttcgcctacgatggcaaggattacatcgccctgaacgaggacctgcnctcctggaccgccgcgaacacagcggctcagatctcccagcacaagtgggaagcggacaaatactcagagcaggtcagggcctacctgagggcaagtgcatggagtggctccgcagacacctggagaacgggaaggagacgctgcagcrcgcggatcccccaaaggcacatgtgacccagcaccccatctctgaccatgaggccaccctgaggtgctgggccctgggcctctaccctgcggagatcacactgacctggcagcaggatggggaggaccagacccaggacacggagcttgtggagaccaggcctgcaggggacggaaccttccagaagtgggtggctgtagtggtgccttccggagaggagcagagatacatgtgccatgtgcagcatgaggggctgccagagcccctcaccctgagatgggagccgtcttctcagcccaccatccccatcgtgggcatcgttgctggcctgtttctccttggagctgtggtcactggagctgtggttgctgctgrgatgtygaggaagaaaagctcaggtagggaaggg

SEQ ID NO: 421 - DNA, 3319 bp, Homo sapiens
ccggaacagaccgccgtgagagaggaggggcgccggccgggattcgcggcccggagctcgggaccggagtcaggaatggagagaagggtaatggtkttacctcttattgtggaaacctgttgagatcacagagaatatactgacggcataaaagggcagaaccatagcagggtgcgcgcygctgtagttgccttccatggatctataggagagcaagtcctccaggagaagaagtcctcaccagtgaacggagacctctctgaactaagrataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagrgacagagacaaaattcagggcttccaggcaaagggagaagctgatatcctggccgcgctgaagaagctccaggaccagaggcagtayattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttytgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctrggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgaygactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccrggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgtthtaagagactgttccaacggctytgggcctcagtggtcacttgaccaccattgtctcagagctgcccactttgtgtgtgtcacatgctgcctgagtcacaygtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 422 - DNA, 3253 bp, Homo sapiens
gagtcaggaatggagagaagggtaatggtkttacctcttattgtggaaacctgttgagatcacagagaatatactgacggcataaaagggcagaaccatagcagggtgcgcgcygctgtagttgccttccatggatctataggagagcaagtcctccaggagaagaagtcctcaccagtgaacggagacctctctgaactaagrataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagrgacagagacaaaattcagggcttccaggcaaagggagaagctgatatcctggccgcgctgaagaagctccaggaccagaggcagtayattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttytgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctrggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgaygactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccrggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgtthtaagagactgttccaacggctytgggcctcagtggtcacttgaccaccattgtctcagagctgcccactttgtgtgtgtcacatgctgcctgagtcacaygtacatcttatttctgcctctagttttgtaagctcctggagggcggataacatcttatactactcttgtattctcatggcacctagtgcagtgctgggcacagagtaggtgctcaataaagacttgttgaatgaacag

SEQ ID NO: 423 - DNA, 3129 bp, Homo sapiens
aggaggggcgccggccgggattcgcggcccggagctcgggaccggttgcttcattccagcctcgcagtcacctctgtgccctgctggttgtcttcccagcgcygctgtagttgccttccatggatctataggagagcaagtcctccaggagaagaagtcctcaccagtgaacggagacctctctgaactaagrataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagrgacagagacaaaattcagggcttccaggcaaagggagaagctgatatcctggccgcgctgaagaagctccaggaccagaggcagtayattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttytgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctrggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgaygactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccrggttccccagcagggtgttaagcctctgtctctggccctaccagcatccaggttccactttcctaggagagagtggagatgggaagacagggaaaggaaggcagcaggaggccacaagcccaccagccaaattgatctcccagtcttgtccttacccattccaagtgctctgccagcccctgttcatccaagttttaagtcctccaccctgtthtaagagactgttccaacggctytgggcctcagtggtcacttgaccaccattgtctcagagctgcccactttgtgtgtgtcacatgctgcctgagtcacaygtacatcttatttctgcctctagttttgtaagctcctggagggcggataacatcttatactactcttgtattctcatggcacctagtgcagtgctgggcacagagtaggtgctcaataaagacttgttgaatg

SEQ ID NO: 424 - DNA, 1201 bp, Homo sapiens
aggaggggcgccggccgggattcgcggcccggagctcgggaccggttgcttcattccagcctcgcagtcacctctgtgccctgctggttgtcttcccagcgcygctgtagttgccttccatggatctataggagagcaagtcctccaggagaagaagtcctcaccagtgaacggagacctctctgaactaagrataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagrgacagagacaaaattcagggcttccaggcaaagggagaagctgatatcctggccgcgctgaagaagctccaggaccagaggcagtayattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggtgagaggccgtccctgggcagggcgccagggaccaggacggtgggtcccagccctgccattcacttgcaggaccttagaagacttgggggctcagttttgtcatctgaaacatggagatgataatccttactgctgccaattagtctgtagattgcatgagcataaaatgaaataactggcatgctgtcacttcaaaaaataaactttttacacaaaactgttcaaaaaactaaatg

SEQ ID NO: 425 - DNA, 1203 bp, Homo sapiens
cccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaratgcgttcagccgatgaagggcaaactgtcttctacacctgtaccaactgcaagttccaggagaaggaagactcttgacctttttcctgggcaactctrcagtccctccctcctttcggaaggtgmaggatactgggtttttagatgccttgtccatcctgtctggttgcaatgttttgctcccagaagagaatcagatcatcatgtggggattaccattgttcctggagtactcctacccttagttgaatttccttattaaagttatatttttctrtaagaccctgacatatgtatgttacttataatctgtcttattccaaaaggaatttaaatgagtttccagagawatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacrgaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaag

SEQ ID NO: 426 - DNA, 1212 bp, Homo sapiens
gcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaratgcgttcagccgatgaagggcaaactgtcttctacacctgtaccaactgcaagttccaggagaaggaagactcttgacctttttcctgggcaactctrcagtccctccctcctttcggaaggtgmaggatactgggtttttagatgccttgtccatcctgtctggttgcaatgttttgctcccagaagagaatcagatcatcatgtggggattaccattgttcctggagtactcctacccttagttgaatttccttattaaagttatatttttctrtaagaccctgacatatgtatgttacttataatctgtcttattccaaaaggaatttaaatgagtttccagagawatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacrgaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaag

SEQ ID NO: 427 - DNA, 1313 bp, Homo sapiens
gcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctsttttgttaataaacttccaactccctcctcagacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaratgcgttcagccgatgaagggcaaactgtcttctacacctgtaccaactgcaagttccaggagaaggaagactcttgacctttttcctgggcaactctrcagtccctccctcctttcggaaggtgmaggatactgggtttttagatgccttgtccatcctgtctggttgcaatgttttgctcccagaagagaatcagatcatcatgtggggattaccattgttcctggagtactcctacccttagttgaatttccttattaaagttatatttttctrtaagaccctgacatatgtatgttacttataatctgtcttattccaaaaggaatttaaatgagtttccagagawatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacrgaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaag

SEQ ID NO: 428 - DNA, 2643 bp, Homo sapiens
  misc_feature (1)...(2643): n = A,T,C or G, or insertion/deletion polymorphism (see Tables 1-2)
aaccaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcrccstggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctccwcttgtcgcaggcccaaagctgccagcccagcagcagagagtggtcttagaagaggatgtcattcytctctcaccatctgtrggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtgggstccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagsccacagcacagcttttgcccctggaaggtcctaaagaggagaaagtagcaatgcacgctcccctggctgtttcttcctcctcatcctcctcctgtgaacaaganggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccytgggaagccaggaacaagatattccaacatctgcaaagaagaaaaggatcacaaacagcagagagcacaaactgnagtagtggggactaccaaggagctggtctcgaaagcaacccacatgaagccaccgcrgaccccgccaggggaagctgaacacagaaagcggagtcagagccttgcaatatgtcagtggaacaagaattcccgttagactaagagccctgaggatctaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttcatttccaaatctctttattatcataattaacctttacttggaaagcaagcagtaaaacctgttcagacagcatcattatattactttcaggcaaacaagcgtggaggacctctacaccctcaagttaaaaaaggcactgaggccgggcgcggtggctcacgcctgtaatcccaacactttgggaggccaaggtgggtggatcacgaggtcaagagatcgagaccatcctggccaacatggtgaaaccccgtctctactaaaaatacaaaaaaaatagccgggcatggtggcgggtgcctgtagtgccagctactcgggaggctgaggcaggagaatggtgtgaacccgggaggcggaacttgcrgtgagccgagatcacgccactgcactccagcctgggcaacagagygagactgtctcaaaaaamaaccaaccaaacaaacaaaaaagcactgaaagagacagactccagttcccggaaggctgacccagtcagcactaaaaacaggattaatgtatagctattaagagaatcatacagtggctttattcttactacttaaaaaaaggtgatgtgatggcagtgatggtcaacatcacacagggaagaccaggtccacgctttgtccagaatcaactgctaccacatgagtcttcttggttaagtcatttgagcccacagtgacagaataggtccctggatatacttctatgtagaggtccttagagatgttct

SEQ ID NO: 429 - DNA, 2664 bp, Homo sapiens
  misc_feature (1)...(2664): n = A,T,C or G, or insertion/deletion polymorphism (see Tables 1-2)
aaccaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcrccstggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgaggcaatgttttctttcccacagctggagagacagggggtcctgcttgtggaattcgaggctccwcttgtcgcaggcccaaagctgccagcccagcagcagagagtggtcttagaagaggatgtcattcytctctcaccatctgtrggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtgggstccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagsccacagcacagcttttgcccctggaaggtcctaaagaggagaaagtagcaatgcacgctcccctggctgtttcttcctcctcatcctcctcctgtgaacaaganggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccytgggaagccaggaacaagatattccaacatctgcaaagaagaaaaggatcacaaacagcagagagcacaaactgnagtagtggggactaccaaggagctggtctcgaaagcaacccacatgaagccaccgcrgaccccgccaggggaagctgaacacagaaagcggagtcagagccttgcaatatgtcagtggaacaagaattcccgttagactaagagccctgaggatctaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttcatttccaaatctctttattatcataattaacctttacttggaaagcaagcagtaaaacctgttcagacagcatcattatattactttcaggcaaacaagcgtggaggacctctacaccctcaagttaaaaaaggcactgaggccgggcgcggtggctcacgcctgtaatcccaacactttgggaggccaaggtgggtggatcacgaggtcaagagatcgagaccatcctggccaacatggtgaaaccccgtctctactaaaaatacaaaaaaaatagccgggcatggtggcgggtgcctgtagtgccagctactcgggaggctgaggcaggagaatggtgtgaacccgggaggcggaacttgcrgtgagccgagatcacgccactgcactccagcctgggcaacagagygagactgtctcaaaaaamaaccaaccaaacaaacaaaaaagcactgaaagagacagactccagttcccggaaggctgacccagtcagcactaaaaacaggattaatgtatagctattaagagaatcatacagtggctttattcttactacttaaaaaaaggtgatgtgatggcagtgatggtcaacatcacacagggaagaccaggtccacgctttgtccagaatcaactgctaccacatgagtcttcttggttaagtcatttgagcccacagtgacagaataggtccctggatatacttctatgtagaggtccttagagatgttct

SEQ ID NO: 430 - DNA, 1019 bp, Homo sapiens
agctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggttkttttttgagacagtctcrctctgttgcccaggctggagtgcagtggcgtgatctcggctcacygcaagttccgcctcccgggttcacaccattctcctgcctcagcctcccgagtagctggcactacaggcacccgccaccatgcccggctattttttttgtatttttagtagagacggggtttcaccatgttggccaggatggt

SEQ ID NO: 431 - DNA, 602 bp, Homo sapiens
agctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgtgagtacggaactgcttayg

SEQ ID NO: 432 - DNA, 1100 bp, Homo sapiens
agctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggttkttttttgagacagtctcrctctgttgcccaggctggagtgcagtggcgtgatctcggctcacygcaagttccgcctcccgggttcacaccattctcctgcctcagcctcccgagtagctggcactacaggcacccgccaccatgcccggctattttttttgtatttttagtagagacggggtttcaccatgttggccaggatggt

SEQ ID NO: 433 - DNA, 641 bp, Homo sapiens
agctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacayagggaatggtcaggctgagaacatctctaaggacctctacatagaagtatatccagggacctattctgtcactgtgggctcaaatgacttaaccaagaagactcatgtggtagcagttgattctggacaaagcgtggacctggtcttccctgtg

SEQ ID NO: 434 - DNA, 1312 bp, Homo sapiens
cccccgacccccgacccccgacccccggcccccgacccccgacccccggcccccagcgcccggcgccccgcctccagcgctcagcagttaaccaggcaactcgcgcgcagacgccaaggctgggacgcagaaggcgtgtttggccgcccagccgccccgcctcccccacttctcccgcctctcccgcctctcccgccttccgccaatggcccagctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagagagaagagagacccccaacccttagtgcttccttcagaacaatggctgaattcatggactatacttcaagtcagtgtgggaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggttkttttttgagacagtctcrctctgttgcccaggctggagtgcagtggcgtgatctcggctcacygcaagttccgcctcccgggttcacaccattctcctgcctcagcctcccgagtagctggcactacaggcacccgccaccatgcccggctattttttttgtatttttagtagagacggggtttcaccatgttggccaggatggt

SEQ ID NO: 435 - DNA, 4716 bp, Homo sapiens
ccttggtttccgttgcagattcccacaactccatgctgtgtgctgcaggctggtcctgaacccagatctctggctgagaggatgggggcagatggggaaacagtggttctgaagaacatgctcattggcgtcaacctgatccttctgggctccatgatcaagccttcagagtgtcagctggaggtcaccacagaaagggtccagagacagtcagtggaggaggagggaggcattgccaactacaacacrtccagcaaagagcagcctgtggtcttcaaccacgtgtacaacattaaygtgcccttggacaacctctgctcctcagggctagaggcctctgctgagcaggaggtgagtgcagaagacgagactctggcagagtacatgggccagacctcagaccacgagagccaggtyacctttacacacaggatcaacttccccaaaaaggcctgtccatgtkccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcmactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcartgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacacygtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccargggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcrgagacctccatctccctcatctggaccaaggccagtggccccattgaccactaccgaattacctttaccccrtcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcscatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatytcctggcagcctcccagggcagagattgaaaattatgtcttgacctacaaatccaccgayggaagccgcaaggagctgattgtggatgcagaagacacctggattcgactggagggcctgttggagaacacagactayacggtgctcctgcaggcagcacaggacaccacgtggagcagcatcacctccaccgctttcaccacaggaggccgggtgttccctcatccccaagactgtgcccagcatttgatgaatggagacaytttgagtggggtttaccccatcttcctcaatggggagctgagccagaaattacaagtgtactgtgatatgaccaccgacgggggcggctggattgtrttccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccargaggccgccttcgcctcctacgacaggttctctgtcgaggacagcagaaacytgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 436 - DNA, 2697 bp, Homo sapiens
tgtttgtttctccatccactgatagatctggtacctggcactgagtatggagttggaatatctgccgtcatgaactcacagcaaagcgtgccagccaccatgaatgccaggactgaacttgacagtccccgagacctcatggtgacagcctcctcrgagacctccatctccctcatctggaccaaggccagtggccccattgaccactaccgaattacctttaccccrtcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcscatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatytcctggcagcctcccagggcagagattgaaaattatgtcttgacctacaaatccaccgayggaagccgcaaggagctgattgtggatgcagaagacacctggattcgactggagggcctgttggagaacacagactayacggtgctcctgcaggcagcacaggacaccacgtggagcagcatcacctccaccgctttcaccacaggaggccgggtgttccctcatccccaagactgtgcccagcatttgatgaatggagacaytttgagtggggtttaccccatcttcctcaatggggagctgagccagaaattacaagtgtactgtgatatgaccaccgacgggggcggctggattgtrttccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccargaggccgccttcgcctcctacgacaggttctctgtcgaggacagcagaaacytgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 437 - DNA, 3364 bp, Homo sapiens
  misc_feature (1)...(3364): n = A,T,C or G, or insertion/deletion polymorphism (see Tables 1-2)
cagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcnctnctctccgtccgtgtctactacaagaagtgccccgagctgctgcagggcctggcccacttccctgagaccatcgcyggctctgatgcaccttccctggccactgtggccggcacctgtgtggaccatgccgtggtgccaccsgggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccytccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacrgactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctkgtccaggtgcaggcactgacgcaggagggccagggggccggcagcaaggtgcacgaattccagacgctgtccccggagggatctggcaacttggcggtgattggcggcrtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcaygctgaagacatcctcggggaagaaggaggtgccggtggccatcaagacgctgaaagccggctacacagagaagcagcgagtggacttcctyggcgaggccggcatcatgggccagttcagccaccacaacatcatccgcctrgagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacraggtgatgaaagccatcaatgatggcttccggctccccacrcccatggactgcccctccgccatctaccagctcatgatgcagtgctggcagcaggagcgtgcccgccgccccaagttcgctgacatcgtcagcatcctggacaagctcattcrtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatygcctacagcctgctgggactcaaggaccaggtgaacactgtggggatccccatctgagcctcgacagggcctggagccccatcggccaagaatacttgaagaaacagagtggcctccctgctgtgccatgctgggccactggggaagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattc

SEQ ID NO: 438 - DNA, 3921 bp, Homo sapiens
  misc_feature (1)...(3921): n = A,T,C or G, or insertion/deletion polymorphism (see Tables 1-2)
cagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcnctnctctccgtccgtgtctactacaagaagtgccccgagctgctgcagggcctggcccacttccctgagaccatcgcyggctctgatgcaccttccctggccactgtggccggcacctgtgtggaccatgccgtggtgccaccsgggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccytccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacrgactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctkgtccaggtgcaggcactgacgcaggagggccagggggccggcagcaaggtgcacgaattccagacgctgtccccggagggatctggcaacttggcggtgattggcggcrtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcaygctgaagacatcctcggggaagaaggaggtgccggtggccatcaagacgctgaaagccggctacacagagaagcagcgagtggacttcctyggcgaggccggcatcatgggccagttcagccaccacaacatcatccgcctrgagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacraggtgatgaaagccatcaatgatggcttccggctccccacrcccatggactgcccctccgccatctaccagctcatgatgcagtgctggcagcaggagcgtgcccgccgccccaagttcgctgacatcgtcagcatcctggacaagctcattcrtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatygcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatrggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccg

SEQ ID NO: 439 - DNA, 16101 bp, Homo sapiens
cagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcrctgcaggagatgctggctaacaccgtggagaaatcagaaggggcaattgatgtggaaaaatggactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccartatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctyagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacaygcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacragaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatactgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctgggaagtggaacatcctcagagatctaaaaaggctgtatggcataaactactgtcyaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcraagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggcc

SEQ ID NO: 440 - DNA, 16137 bp, Homo sapiens
cagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcrctgcaggagatgctggctaacaccgtggagaaatcagaaggggcaattactcttttgtgtttttctctcttgttctccttttttctcttctctctaaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccartatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctyagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacaygcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacragaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatactgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcggagacattactgtctgggaagtggaacatcctcagagatctaaaaaggctgtatggcataaactactgtcyaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcraagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgccccccccccccgcccccgcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggcc

SEQ ID NO: 441 - DNA, 15787 bp, Homo sapiens
cagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcrctgcaggagatgctggctaacaccgtggagaaatcagaaggggcaattactcttttgtgtttttctctcttgttctccttttttctcttctctctaaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccartatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcttctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctyagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgttccattattaaatgaacaygcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggcttggggctggagaattgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacragaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacataccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatactgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacaggtggaacatcctcagagatctaaaaaggctgtatggcataaactactgtcyaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcraagctctgtttcggaagagctgtttcctcccccatatgctcctgctattattttggtaatgctctgatgcaacattgcaactttatgaaatctttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgctcattctttcagccacctgtgatcagttttgttgattaaggacttcttgtcaggccattttttaatatcaaagctgaagcaatatccattcagggatttcatcagttgcrtcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaac

SEQ ID NO: 442 - DNA, 15731 bp, Homo sapiens
cgcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcrctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccartatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcrcaagaagcaatggtggacaagttggcagaaaatgcacataatgtgtgggcgcgggatcgaatccggcagggctggacttatggcatccaacaggacgtaaagaacagaagaaatcctcgccttgttccctacactcctctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctyagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgtcccattattaaatgaacaygcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggctaggactatgagaactgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacragaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcktcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacattccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatacygaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcgaagacattactgtctggtggaacatcctcagagatctaaaaaggctgtatggcataaactactgtctaagyagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgatgtgtgttttctgggagcatcraagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgcc

SEQ ID NO: 443 - DNA, 1157 bp, Homo sapiens
cacccgggaaacckgaagccgcctcccacttggttgctcgtacgcggctagtgggtcctcagtggatgtaggctgggcgccgcgatgttcgacgggacaccggcggagagcgacctcggggttaaggggtggggctgacgtcaggarccaagatggcggcggtggtcgcmctctccttgaggcgccggttgccggccacaacccttggcggagcctgcctgcaggcctcccgaggagcccagacagctgcagccacagctccccgtatcaagaaatttgccatctatcgatgggacccagacaaggctgragacaaacctcrtatgcagrcttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaayctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaagaa

SEQ ID NO: 444 - DNA, 1006 bp, Homo sapiens
ccaagatggcggcggtggtcgcmctctccttgaggcgccggttgccggccacaacccttggcggagcctgcctgcctcccgaggagcccagacagctgcagccacagctccccgtatcaagaaatttgccatctatcgatgggacccagacaaggctgragacaaacctcrtatgcagrcttatgaagttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaayctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaagaaataaatgttattctactttattaacaaaaaaaaaagaa

SEQ ID NO: 445 - DNA, 1800 bp, Homo sapiens
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagcygccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgyggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagaggtttgatca

SEQ ID NO: 446 - DNA, 1652 bp, Homo sapiens
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggcattactacagcygccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgyggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagaggtttgatca

SEQ ID NO: 447 - DNA, 1904 bp, Homo sapiens
cgccccgggagcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcgtttgtttcagagaagatgcaatttatcctgagggagaatggaaaagtccaaactttggtagattatgagagtagggttcgatgttagtgaagttttcaaggatggcatgtcaaaaccagacttcctcaggaactgcttcatgtggatatactgatgagcctcagagcatcatgtgatggtgaccagggagtgacctcaagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagcygccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgyggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataataaagttcctatagtttatttttttaaaaaacttaaaaattgttacaatacataatgaaaaaataatccattaaacataaaaagaggtttgatca

SEQ ID NO: 448 - DNA, 1561 bp, Homo sapiens
ggcccgctccaacatcagaatggtaacagctttcaggagcctaccacgcggcagctccggagctgccgcgtccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagcygccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgyggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaa

SEQ ID NO: 449 - DNA, 9417 bp, Homo sapiens
  misc_feature (1)...(9417): n = A,T,C or G, or insertion/deletion polymorphism (see Tables 1-2)
cccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcrcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttyttccaagaggaaacaggagtacgggtagaattagcagaagaagaygatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcayagaatctcgagtgagcagccaacagrcagtttcatatggttcccaacatgaacaggcacattctacaggcacagtcccagggcatayaccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcarattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgsgttgggagactagctgaccagaacacagcctgtgtgttgtacactgaagaatctggrtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaayataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcatt

SEQ ID NO: 450 - DNA, 8678 bp, Homo sapiens
  misc_feature (1)...(8678): n = A,T,C or G, or insertion/deletion polymorphism (see Tables 1-2)
cccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcrcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttyttccaagaggaaacaggagtacgggtagaattagcagaagaagaygatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcayagaatctcgagtgagcagccaacagrcagtttcatatggttcccaacatgaacaggcacattctacaggcacagtcccagggcatayaccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcarattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattangagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttytttgctctttagaacccagtgaaaaattaagcaaaagatattagcagctttgactgcagcattagcaattaggaaaaaaa

SEQ ID NO: 451 - DNA, 6294 bp, Homo sapiens
  misc_feature (1)...(6294): n = A,T,C or G, or insertion/deletion polymorphism (see Tables 1-2)
gcaccacagagtttgatcctagtagatcatcaggaacatggaaatctaatagttgagtgtcagaataactagcaataacatgtcaactagagaagcaaaatagtaaaattctgagaaaggattggataatgatgttcagtgattcctgatccatttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaattyattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggtaataaagcaaccatcatcgtccaaaaacaataaaatggagatgttgccatacctgggacaaaagcctgttaaggcgsgttgggagactagctgaccagaacacagcctgtgtgttgtacactgaagaatctggrtgaaaagggaagtggagtgataatgagaatcggtgggctcactgctcccattaggtgaaattactttttttcaaggaattacagtgaaaagttacatctgtgtggcctatatgacttgctcatttgggatttggaacttaggctttaatattaggctgagatttcctggatgaaattctaaggtgttttagcagtttctgaagctaatacattttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaayataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcatt

SEQ ID NO: 452 - DNA, 7853 bp, Homo sapiens
  misc_feature (1)...(7853): n = A,T,C or G, or insertion/deletion polymorphism (see Tables 1-2)
cccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcrcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttyttccaagaggaaacaggagtacgggtagaattagcagaagaagaygatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcayagaatctcgagtgagcagccaacagrcagtttcatatggttcccaacatgaacaggcacattctacaggcacagtcccagggcatayaccttctactgtccaagcacagtctcagccccatggggtatatccaccctcaagtgtgcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattangagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttytttgctctttagaacccagtgaaaaattaagcaaaagatattagcagctttgactgcagcattagcaattaggaaaaaaa

SEQ ID NO: 453 - DNA, 4872 bp, Homo sapiens
  misc_feature (1)...(4872): n = A,T,C or G, or insertion/deletion polymorphism (see Tables 1-2)
atggttcccaacatgaacaggcacattctacaggcacagtcccagggcatayaccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattangagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttytttgctctttagaacccagtgaaaaattaagcaaaagatattagcagctttgactgcagcattagcaattaggaaaaaaa

SEQ ID NO: 454 - DNA, 9639 bp, Homo sapiens
  misc_feature (1)...(9639): n = A,T,C or G, or insertion/deletion polymorphism (see Tables 1-2)
cccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcrcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttyttccaagaggaaacaggagtacgggtagaattagcagaagaagaygatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcayagaatctcgagtgagcagccaacagrcagtttcatatggttcccaacatgaacaggcacattctacaggcacagtcccagggcatayaccttctactgtccaagcacagtctcagccccatggggtatatccaccctcaagtgtgcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattangagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttytttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtargtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctathtatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggstggaggctcctgtaccctgttcattccttaagggccctgcttcccttartaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttayttactgttgatttcatcctcctgtgtatgaaatamcaagcctagaggaatga

SEQ ID NO: 455 - DNA, 10464 bp, Homo sapiens
  misc_feature (1)...(10464): n = A,T,C or G, or insertion/deletion polymorphism (see Tables 1-2)
cccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcrcagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttyttccaagaggaaacaggagtacgggtagaattagcagaagaagaygatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcayagaatctcgagtgagcagccaacagrcagtttcatatggttcccaacatgaacaggcacattctacaggcacagtcccagggcatayaccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcarcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcarattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatkatcacagtgacttctgcggttggtcctgtgtccatggcggctcyaacagcaatcacrgaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattangagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttytttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtargtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctathtatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggstggaggctcctgtaccctgttcattccttaagggccctgcttcccttartaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttayttactgttgatttcatcctcctgtgtatgaaatamcaagcctagaggaatga

SEQ ID NO: 456 - DNA, 8238 bp, Homo sapiens
  misc_feature (1)...(8238): n = A,T,C or G, or insertion/deletion polymorphism (see Tables 1-2)
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttnataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaactgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagtaaagtggaagagtgctttgatctcagttgctaatgatgatggactaatctttagaagaacggaggccttgattggtgatttcatgggaacaaaacagatttctgcattacctctgcctg

SEQ ID NO: 457 - DNA, 7846 bp, Homo sapiens
  misc_feature (1)...(7846): n = A,T,C or G, or insertion/deletion polymorphism (see Tables 1-2)
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatcaaaacattgaccaagattccctctttgatcaaggatgggttaagttgcttgatagtgctcctgcagagacagaagccagagagccttgggaaaaagtatgtacaattgaattgagaaatggtgctagtcagaggccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataata

SEQ ID NO: 458 - DNA, 7914 bp, Homo sapiens
  misc_feature (1)...(7914): n = A,T,C or G, or insertion/deletion polymorphism (see Tables 1-2)
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatcaaaacattgaccaagattccctctttgatcaaggatgggttaagttgcttgatagtgctcctgcagagacagaagccagagagccttgggaaaaagtatgtacaattgaattgagaaatggtgctagtcagaggccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaactgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagtaaagtggaagagtgctttgatctcagttgctaatgatgatggactaatctttagaagaacggaggccttgattggtgatttcatgggaacaaaacagatttctgcattacctctgcctg

SEQ ID NO: 459 - DNA, 7967 bp, Homo sapiens
  misc_feature (1)...(7967): n = A,T,C or G, or insertion/deletion polymorphism (see Tables 1-2)
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatcaaaacattgaccaagattccctctttgatcaaggatgggttaagttgcttgatagtgctcctgcagagacagaagccagagagccttgggaaaaagtatgtacaattgaattgagaaatggtgctagtcagaggccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagtaaagtggaagagtgctttgatctcagttgctaatgatgatggactaatctttagaagaacggaggccttgattggtgatttcatgggaacaaaacagatttctgcattacctctgcctg

SEQ ID NO: 460 - DNA, 2840 bp, Homo sapiens
  misc_feature (1)...(2840): n = A,T,C or G, or insertion/deletion polymorphism (see Tables 1-2)
cctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataata

SEQ ID NO: 461 - DNA, 7870 bp, Homo sapiens
  misc_feature (1)...(7870): n = A,T,C or G, or insertion/deletion polymorphism (see Tables 1-2)
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcrgccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataata

SEQ ID NO: 462 - DNA, 3093 bp, Homo sapiens
  misc_feature (1)...(3093): n = A,T,C or G, or insertion/deletion polymorphism (see Tables 1-2)
tagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggyggctgcctrtggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaatgattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatscttttgtcccagtgctgancactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacgggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagragccttgatgatgcctctggtggatcagctggtaaacaggcttgggggagaagagaaattccaggaacgggtgacaaagcacctgataccatgcatcgcacagttttcngtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttcmttacaaaatccccacctggcttgtgctgccacataagcctctcctgcctatcgtatagagctgcagaaagagtaaatgatacacggtatttttatac

SEQ ID NO: 463 - DNA, 877 bp, Homo sapiens
tctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttctttygctgggctccaagatcttaaagccacggagaagcctctcatcttayggcaytgacaaagagaagaccatccaccttaccctgaaagtrgtgaagcccagtgatgaggagctgcccttgtttcttgtggagycaggtgatgaggsaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatsttattktattggagggtgaccaccctgggsatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatttaattctgtcttgataccttgttatttatgcaaaaactcctatctcctttcctttatgacaagagagtaagtt

SEQ ID NO: 464 - DNA, 1900 bp, Homo sapiens
atgaccaaaaagatgattccagaagtgcaggacaactccctacccagaggctgtggctgtgcagtaacacaccaagaggggagtccagctggctctcagggtgctcactaccctcatctgggggcctggaggacgtcaattcctgagaacgccacgttctataagggagatgtgggtgagtggctgtcagcaggaaaaggtgagagttcagctatgtttgcatctgagcaggaaatttccaaggatgagcagggaactccagtgctgggctcattttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggygctcctacctctatagccaccagtttgttcacartcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgytctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagrggtccatmcaggggcttttggatgtgaaccatgcaccagtggccaggtcccaggaacccatatttagaactgagggtcctatggcccagaaccaggcatctgtacttaagaaccaagcacctgtgaccaggacccaggcacccatcacyggaaccctctgtcaggwtgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagc

SEQ ID NO: 465 - DNA, 1357 bp, Homo sapiens
tctctcctgttcttccagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagacccgggtgcttcaagcatcccaggctgggccaccctttttttgctacacctgtggcaaatgtttcagcaggygctcctacctctatagccaccagtttgttcacartcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgytctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagrggtccatmcaggggcttttggatgtgaaccatgcaccagtggccaggtcccaggaacccatatttagaactgagggtcctatggcccagaaccaggcatctgtacttaagaaccaagcacctgtgaccaggacccaggcacccatcacyggaaccctctgtcaggwtgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagc

SEQ ID NO: 466 - DNA, 1585 bp, Homo sapiens
agaagaaactgtctctacaccttcattctcaggacaagttcattgtctggcaccaagctccttggggtgaattttcttccaaaagagtccggggagtccaggtccttcwtcctggwtactcataacgcggccccatttctcactcccattgggcgtcgsgtttctagagaagccaatcagtgtcgccgcagttcccaggttctaaagtcccacgcaccccgcgggactcatatttttcccagacgcggaggttggggtcatggcgccccgaagcctcctcctgctgctctcaggggycctggccctgaccgatacttgggcrggctcccactcmttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctyctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaawcttgatgataacatggtggtcaagcttatttctcctgggggtgctcttccaaggatatttgggctgcctccggagtcacagtgtcttgggccgccrgaaggtgggtgacatgtggatcttgttttttttgtggctgtggacatctttcaacactgccttcttggccttgcaaagccttygctttggcttcggctttaggaggggcaggagcttccttcttcgttcttggcaccatcttatgaaaagggtccagattaagatttttgac

SEQ ID NO: 467 - DNA, 1188 bp, Homo sapiens
atggcgccccgaagcctcctcctgctgctctcaggggccctggccctgaccgatacttgggcrggctcccactcmttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtamgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctyctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtcactgacagtgcycagggctctggggtgtctctcacagctaataaagtgtgagacagcttccttgtgtgggactgagaagcaagatatcaatgtagcagaattgcacttgtgcctcacgaacatacataaattttaaaaataaagaataaa

SEQ ID NO: 468 - DNA, 1161 bp, Homo sapiens
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttccctygggcttttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactsttggcctcrtcttcctctgcctgcagtacagactgagaggaaaacttcgagcagagatagagaatctccaccggacttttgagtcctttggtgttctaggaccccaggttaaggaaccaaaaaagacagatccccactttctgagggtgccctgctggaagataaccctgtttgtaattgtgccggttcttggacccttggttgccttgatcatctgctacaactggctacatcgaagactagcaggt

SEQ ID NO: 469 - DNA, 1089 bp, Homo sapiens
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttccctygggcttttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactsttggcctcrtcttcctctgcctgcagtacagactgagaggaaaacttcgagcagagatagagaatctccaccggacttttgagtcctttggtgttctaggaccccaggttaaggaaccaaaaaagacagggcaattccttgaagagctactcttccacctggaagccctctctggc

SEQ ID NO: 470 - DNA, 426 bp, Homo sapiens
gggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtcacccaggattggttgcagtggcacgatcatggctcattgcagcctccacctcccaggctcaag

SEQ ID NO: 471 - DNA, 1017 bp, Homo sapiens
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttccctygggcttttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactsttggcctcrtcttcctctgcctgcagtacagactgagaggaaaacttcgagcagagatagagaatctccaccggacttttgggcaattccttgaagagctacgt

SEQ ID NO: 472 - DNA, 1582 bp, Homo sapiens
atggcaagcttatcragaccctctctgcccagctgcctctgctccttcctcctcctcctcctcctccaagtgtcttccagctatgcagatcctttctactgggtgagccctggagtgctggttctcctcgcggtgctgcctgtgctcctcctgcagatcactsttggcctcrtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaamtcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgygccactgcactctagccrgagtgacagagtaagactctgtctcaaaaataaataaataaataaataaataaataaataaataaataaataaaaaataataatacaagttttcataagcacacttcta

SEQ ID NO: 473 - DNA, 2332 bp, Homo sapiens
acatattccatgaacaagcctcttcctaaggtcctgtaagtgatcctgccccactgattagcccctagaagacccttcaaaggttggatctccaggagggagtgggggaggaaagccctgtaccaggcagcctctgctccattgctctgggggggtggggaaggcaaaccctggtcatcccctcagtctgtagcccttttgtgtgagtgcctggcaagggtgacgtggggctgtttctgcgggcacagctgcagcaattaccggagtggaggcagggcccaggcagcactgccctccaagatcttccctygggcttttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactsttggcctcrtcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaamtcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgygccactgcactctagccrgagtgacagagtaagactctgtctcaaaaataaataaataaataaataaataaataaataaataaataaataaaaaataataatacaagttttcataagcacacttcta

SEQ ID NO: 474 - DNA, 3170 bp, Homo sapiens
taggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttcracccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttygccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccrcacctggggaagtggggaccacgccvtctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagayctaaggtccaccgccaaggcaccatcggacacacctgcccatgagtagacacagcagcgagcaaataggtctsataaataccccccttccrttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacargccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccc

SEQ ID NO: 475 - DNA, 3277 bp, Homo sapiens
taggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttcracccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttygccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccrcacctggggaagtggggaccacgccvtctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagayctaaggtccaccgccaaggcaccatcggacacacctgcccatgagtagacacagcagcgagcaaataggtctsataaataccccccttccrttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacargccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccc

SEQ ID NO: 476 - DNA, 3031 bp, Homo sapiens
taggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgrttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcygagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgcrccaccccaacgcaatcggaggaaatvtgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacayacctgcccatgagtagacacagcagcgagcaaataggtctgataaataccccccttcccttccctccccaagsgggaatgactacagggargaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagartatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccc

SEQ ID NO: 477 - DNA, 1080 bp, Homo sapiens
atgctgccctgcttccaactgctgcgcatagggggcggcaggggcggtgatctctacaccttcracccccccgccggggytggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttygccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccrcacctggggaartggggaccacgccvtctgctccaccccaacgcaatcggaggaaatctgttcaccgagtgttggcggaactggatgatgagagtgagcctcytgagaacccgccaccggtccttatggagcccaggaagaaactccgtgtagacaaagccccactgactcccactggaaatgcacgtggccgtcctcggaagtacccagtgagcgctcccatggctccccctgcagttggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagcctaaggtccaccgccaaggcaccatcggacacacctgcccatgagtag

SEQ ID NO: 478 - DNA, 1386 bp, Homo sapiens
aagccctcatttcaccaggcccccggcttggggcgccttccttccccatggcgggacacctggcttcrgatttygccttctcgccccctccaggtggtggaggtgatgggccaggggggccggagccgggctggrttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggygaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccytcgtgcaggcccgaaagagaaagcgaaccagtatcgagaaccgagtgagaggcaacctggagaatttgttcctgcagtgcccgaaaccsacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctcygtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagataga

SEQ ID NO: 479 - DNA, 1155 bp, Homo sapiens
gtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatccsgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccytcgtgcaggcccgaaagagaaagcgaaccagtatcgagaaccgagtgagaggcaacctggagaatttgttcctgcagtgcccgaaaccsacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctcygtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagataga

SEQ ID NO: 480 - DNA, 1158 bp, Homo sapiens
gtagtcctttgttacatgcatgagtcagtgaacagggaatgggtgaatgacatttgtgggtaggttatttctagaagttaggtgggcagctcggaaggcagatgcacttctacagactattccttggggccacacgtaggttcttgaatccsgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccytcgtgcaggcccgaaagagaaagcgaaccagtatcgagaaccgagtgagaggcaacctggagaatttgttcctgcagtgcccgaaaccsacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtgccccaggctatgggagccctcacttcactgcactgtactcctcggtccctttccctgagggggaagcctttccccctgtctctgtcaccactctgggctctcccttgcattcaaactgaggtgcctgcctgcccttctaggaatgggggacagggggaggggaggagctagggaaagaaaacctggagtttgtgccagggtttttggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagataga

SEQ ID NO: 481 - DNA, 3936 bp, Homo sapiens
cggcggggaacaccggyccgctgtaacaccggcccggcgcagaagcgggacgtcggcttctaggggcccaggccggcggcggygatggcctcggcagctgtggagagcttcgtgaccaagcaactggacctgctggagctygagagagacgcggaggtggaggagcgcaggtcctggcaggagaacatctctctgaaagagctccagagccgaggcgtgtgtttgctgaagctgcaggtatccagccagcgcactgggctgtayggacggctgctggtcacctttgagcccaggcgatacgggtccrcggcagctcttcccagtaacagctttacttctggtgatatcgtgggcctgtacgatgctgctaatgagggcagtcagctgkccactgggatcttgacccgggtcacccagaagtcggtcacggtggcctttgatgagtyccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggtttyatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccrttcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccargccctcgaggcgagctgctggatccccctgctgaaggccagaaagtgcatcctggygggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagytcacagcccactcttccgtggcaaggcacctcctgagggamctcccaggtgtggctgccacagaagagacgggtgtgcccctgctcttggtggacaccgccggctgcgggctgtttgagctggaggaggaggacgaacagtcgaaagggaaccctggcgaagtccgcctcgtyagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccaygtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctrcgtccaccaggaccggaagccagcggcaggagggaggccaggaggctgcagcacctgccagacagggcyggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttcyggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcrcaggggcagcccgccagcaaggagcagcaggcctcagggcagcagaaacttccagaaaagaaaaagaaaaaagccaaaggacatccggccacagatctgcccamggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccycgcggagctctctccatggtagcccagggcgctggcagaccatgctccrcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctyactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagcyggctctcccacgtggytgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactg

SEQ ID NO: 482 - DNA, 2309 bp, Homo sapiens
aggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtygcccgcccartcaacccctccagatgcttggctacctgtcagccaggggtgtaatcactgggtcggggtctgctgctgacctctttaccaaaacagccagcccgctcaccacctcrcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatrtgccgaagtgaagaagtccagtttggtcccatccacagcccggagctcacccatgaaagggtgttcccgcagctcctcctatgccagcacccgatcctccagtcactcgtcccratccccaaatcccagggcttcccccaggtacacccaaagccgatccacctcttctgaaaaaaggtcctactcccgctctcccagctattcctccaagtctggcaagaggagcccgcccagcagaagctctaggtcccgccgcagccctagctactcccgctacagccccagcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtt

SEQ ID NO: 483 - DNA, 3804 bp, Homo sapiens
ttgggggtttattctcttcccttctaacttgacagggtcttgctctgtcattcaggcaagagtggtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccaycggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactrcagttaaacattgtcatcttcggagcactgctcagacccatcwttatcagaggaccagcgtcaccgaaaatagtcatccaggamaatcggaaagaagcgcagtatatgcttgaaaatgagaaaacacraacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcrtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattyctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatawaacttgaacttcataaatgtgaagatwaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttcctttttttttggagtcacactacatgtayagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttgraagaaaatacaaacaagattgctgatctgttctgtattagtgacattctggtacttctagatttgcaataaatttatggattttttatttaaagagac

SEQ ID NO: 484 - DNA, 2860 bp, Homo sapiens
ctttgggggtttattctcttcccttctaacttgattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccaycggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactrcagttaaacattgtcatcttcggagcactgctcagacccatcwttatcagaggaccagcgtcaccgaaaatagtcatccaggamaatcggaaagaagcgcagtatatgcttgaaaatgagaaaacacraacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcrtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattyctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatawaacttgaacttcataaatgtgaagatwaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttt

SEQ ID NO: 485 - DNA, 2211 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccaycggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactrcagttaaacattgtcatcttcggagcactgctcagacccatcwttatcagaggaccagcgtcaccgaaaatagtcatccaggamaatcggaaagaagcgcagtatatgcttgaaaatgagaaaacacraacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcrtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtc

SEQ ID NO: 486 - DNA, 3350 bp, Homo sapiens
aaagtggcttgggtttgaatattgtggttgagtctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggrcccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtycttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacarcagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctrtcagctcaaacataaacagtgataattgtctgaaaatgttgygtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagaygtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgc

SEQ ID NO: 487 - DNA, 1248 bp, Homo sapiens
agtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatmcaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgckggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacawagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaag

SEQ ID NO: 488 - DNA, 2006 bp, Homo sapiens
  misc_feature (1)...(2006): n = A,T,C or G, or insertion/deletion polymorphism (see Tables 1-2)
ttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagttaagcggctttttataattacaggacttttcagaacatttaatatgctaatgtgcattctaaatctccaagaaagaatgatgcatatttatcttttcttccaggtgcatcttagagactggtgtttgcaagtatatggagcaggaaacttcatcccgaagatggagaccccggggctgtcagcaggcgctttataagtcagtggagcctgcggaagtggccagaatccagcactccaagcactgctgtcttctcacagagtcttgaagccagagcagyrccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacntacaactatgtgattagctctcgscttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccrctggaaggcrgagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaac

SEQ ID NO: 489 - DNA, 1544 bp, Homo sapiens
  misc_feature (1)...(1544): n = A,T,C or G, or insertion/deletion polymorphism (see Tables 1-2)
gctttataagtcagtggagcctgcggaagtggccagaatccagcactccaagcactgctgtcttctcacagagtcttgaagccagagcagyrccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacntacaactatgtgattagctctcgscttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccrctggaaggcrgagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaac

SEQ ID NO: 490 - DNA, 1766 bp, Homo sapiens
  misc_feature (1)...(1766): n = A,T,C or G, or insertion/deletion polymorphism (see Tables 1-2)
ctagatgtcagagctggctcccggttgggatatgagtgactttgtggaggatggcgcctaaatgaggcatgccaatttcngcaccagggtgacgaacataagggctcctwaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagyrccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacntacaactatgtgattagctctcgscttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccrctggaaggcrgagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaac

SEQ ID NO: 491 - DNA, 2003 bp, Homo sapiens
  misc_feature (1)...(2003): n = A,T,C or G, or insertion/deletion polymorphism (see Tables 1-2)
cagcctatgacacttttgctcctcctgaaatctccatatcttgcntttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttaggctttataagtcagtggagcctgcggaagtggccagaatccagcactccaagcactgctgtcttctcacagagtcttgaagccagagcagyrccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacntacaactatgtgattagctctcgscttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccrctggaaggcrgagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaac

SEQ ID NO: 492 - DNA, 9250 bp, Homo sapiens
tcttacatccagtccaggacctgtcacaaaagactcacattagtaccacatggtatcctgttttagtaaagaataggtgaaatattttagtgagtagatcctacttttcctttcagatgcaatgaacagaagaccctgaaaggatttcaatccagaatgtcacaggataataagagcagatgtctgtgatgccctttacaaagcacctttacatactgtctctcattcgtctctaatgacacctatgtgatcctccattttttcagatgaggaaactgaggttcagagtgattaagcgagttgcctgagatttcacagctaacacattgtgaaatctagtctagcacccaggactaaaaactctcggcttcttttaaggccacatatcgcctcaccagaagggtggcctctctggagatataccctaccctcggccgacttgatattgagaacttggtcatcttaagcatgtgggccacttgggcaaggcagcccttcccaaattgtaaatgtccccacgtggagctcaagcgtctggcttgagccagaaggtgccctgaacactcggtggccccagcccccacgtaacagcacgtgctcgggtcccacattcggtcagacgcccctctccactggcatctgcccggtggaggcgccactgcgctctgcctccgccccagcaagcgcgtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttcyttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggc

SEQ ID NO: 493 - DNA, 7976 bp, Homo sapiens
cgcggccagtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgttatactctgtatctggttttcctgtgtatgttaaccacttaaatgttattatcctgctttggt

SEQ ID NO: 494 - DNA, 7241 bp, Homo sapiens
cgcggccagtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgttatactctgtatctggttttcctgtgtatgttaaccacttaaatgttattatcctgctttggt

SEQ ID NO: 495 - DNA, 8554 bp, Homo sapiens
tcttacatccagtccaggacctgtcacaaaagactcacattagtaccacatggtatcctgttttagtaaagaataggtgaaatattttagtgagtagatcctacttttcctttcagatgcaatgaacagaagaccctgaaaggatttcaatccagaatgtcacaggataataagagcagatgtctgtgatgccctttacaaagcacctttacatactgtctctcattcgtctctaatgacacctatgtgatcctccattttttcagatgaggaaactgaggttcagagtgattaagcgagttgcctgagatttcacagctaacacattgtgaaatctagtctagcacccaggactaaaaactctcggcttcttttaaggccacatatcgcctcaccagaagggtggcctctctggagatataccctaccctcggccgacttgatattgagaacttggtcatcttaagcatgtgggccacttgggcaaggcagcccttcccaaattgtaaatgtccccacgtggagctcaagcgtctggcttgagccagaaggtgccctgaacactcggtggccccagcccccacgtaacagcacgtgctcgggtcccacattcggtcagacgcccctctccactggcatctgcccggtggaggcgccactgcgctctgcctccgccccagcaagcgcgtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttcyttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggc

SEQ ID NO: 496 - DNA, 2502 bp, Homo sapiens
tcttacatccagtccaggacctgtcacaaaagactcacattagtaccacatggtatcctgttttagtaaagaataggtgaaatattttagtgagtagatcctacttttcctttcagatgcaatgaacagaagaccctgaaaggatttcaatccagaatgtcacaggataataagagcagatgtctgtgatgccctttacaaagcacctttacatactgtctctcattcgtctctaatgacacctatgtgatcctccattttttcagatgaggaaactgaggttcagagtgattaagcgagttgcctgagatttcacagctaacacattgtgaaatctagtctagcacccaggactaaaaactctcggcttcttttaaggccacatatcgcctcaccagaagggtggcctctctggagatataccctaccctcggccgacttgatattgagaacttggtcatcttaagcatgtgggccacttgggcaaggcagcccttcccaaattgtaaatgtccccacgtggagctcaagcgtctggcttgagccagaaggtgccctgaacactcggtggccccagcccccacgtaacagcacgtgctcgggtcccacattcggtcagacgcccctctccactggcatctgcccggtggaggcgccactgcgctctgcctccgccccagcaagcgcgtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttcyttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggtacccaaaagaaaaagcrctgtcaatgctgtgttgtcatgtgaccacttctttcttctcctttcttctgggcagcctgtactctccacc

SEQ ID NO: 497 - DNA, 8118 bp, Homo sapiens
cgcggccagtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggc

SEQ ID NO: 498 - DNA, 7098 bp, Homo sapiens
ctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttarttatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgttatactctgtatctggttttcctgtgtatgttaaccacttaaatgttattatcctgctttggt

SEQ ID NO: 499 - DNA, 7240 bp, Homo sapiens
ctgccattaaagggatctactgttttccagtattttattctgcaaagattttccaaaaagtttcttgtctccagaataactgcattacatctggcagagagtcatatgttttaaagatctgttcatacaaaaggaccttctttttgcaatcctattaatagtcgtattgcacagcctgcaatcatttgccgcaaaatacttgggaagactctggtacaataatgatgtaatctcttccaccttagtagataaaatttaaaaatggcactagcatgtaaacaaaatggaatccataaattagagaggattgggcacctgttactacaagaaaatgaacatttaagggattattagaaaatatctattcaaaagaatttgtcactgtggtttccattttccttcctcttarttatgagtcagtttgtcagcattcacatccataagagatgcagtatttaaccctgacttttgtttactctttattccagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagcagggatggagcagagcaacagggacctgaagcgactgtagargaagctgaagctgcggctttcggctcagaaragcctcagagcatgtttgagccacctcaggtgtcttctcctgttcaagagaaaagggatgtattaccaaagattctgcctgctgaagacagggyrctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgygcttcaygttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaataatggc

SEQ ID NO: 500 - DNA, 1370 bp, Homo sapiens
cgcggccagtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggtacccaaaagaaaaagcrctgtcaatgctgtgttgtcatgtgaccacttctttcttctcctttcttctgggcagcctgtactctccacc

SEQ ID NO: 501 - DNA, 1227 bp, Homo sapiens
atgcacttttgtggaaaacacatcattaatcatttttataaaatattacagttaatgcctctggcttgcatagatatttccttgaatgagaatataataatattgggcaaagtaaacttttcatttactttattactaccatttcagttctttatattcagttttttatattttcaccatctatgctgtattgaaatcaattcagctgaaggaaggaaaaaggtctcttccacctgttcagcccacataacagtggtgattgtgtttcaccggacaatcctcttcatgtacataaagtcaacatctaatagaaattactctgccatgactgaattctttctggtggggctttcccaatatccagagctccagctttttctgttcctgctctgcstcatcatgtacatgataatcctcctgggaaatagcctcctyattatcatcaccatcttggattctcgcctccatactcccatgtatttctttcttggaaacctctcattcttggacatctgttacacatcctcatccattcctccaatgcttattatatttatgtctgagagaaaatccatctccttcattggctgtgctctgcagatggttgtgtcccttggcttgggctccactgagtgtgtcctcctggctgtgatggcctatgaccactatgtggccatctgcaacccactgaggtactccatcatcatgaacggagtgctgtatgtgcaaatggctgcatggtcctggatcataggctgtctgacctccctattgcamacagttctgacaatgatgttgcctttctgtgggaataatgtcattgatcatattacytgtgaaattttggcccttctaaaacttgtttgttcagatatcaycatcaatgtgcttatcatgacagtgacaaatattgtttcactggtgattcttctactgttaattttcatctcctatgtgtttattctctcttccatcctgagaattaattgtgctgagggaagaaagaaagccttctctacctgttcagcgcactygattgtggtcatcttattctacggttcagccctttttatgtacatgaaacccaagtcaaagaacactaatacatctgatgagattattgggctgtcttatggagtggtaagcccaatgttaaatcccatcatctatagcctcaggaataaagakgtcaaagaggctgtaaagaaagtcctgagcagacatctr

SEQ ID NO: 502 - DNA, 7670 bp, Homo sapiens
aaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctsaagaaagtcatccggcacaagcgacagagtggggtgaacgccaccctgccagaagagaaccagccagtggtgtttaaccacgtttacaacatcaagctgccagtgggatcccagtgttcrgtggatctggagtcagccagtggggagaaagacctggcaccgccttcagagcccagcgaaagctttcaggagcacacagtrgatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtraatggagtctgcatctgtttcgaaggctacgccggggctgactgcagccgtgaaatctgcccagtgccctgcagtgaggagcacrgcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccrgggtcgctgtgtgaatgggcagtgcrtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacartgcrtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccrggagctggarcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagrcattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagmgggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggaygagaaccagtactccatcgggaacctgaagcctgacactgagtacgaggtgtccctcrtctcccgcagaggtgacatgkcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcarttacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacrtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcrgaacctcaccgtgcctggcagmcttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacrttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacracagaggccctgccccttctggaaaacctaaccatttccgacattaatccctacgggttcacagtttcctggatggcatcggagaatgcctttgacagctttctagtaacggtggtggattctgggaagctgytggacccccaggaattcacactttcaggaacccagaggaagctggagcttagaggcctcataactggcattggctatgaggttatggtctctggcttcacccaagggcatcaaaccaagcccttgagggctgagattgttacagaagcmgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacwtaacaggtctcagagaggctactgaatacgaaattgaactctatggaataagcaaaggaaggcratcccagacagtcagtgctatagcaacaacagccatgggctccccaaaggaagtcattttctcagacatcactgaaaattcggctactgtcagctggagrgcacccacrgcccaagtggagagcttccgrattacctatgtgcccattacaggaggtacaccctccatggtaactgtggacggaaccaagactcagaccaggctggtgaaactcatacctggcgtggagtaccttgtcagcatcatcrccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagrgacttgactgctactgaggttcagtcggaaactgccctccttacctggcgacccccccgggcatcagtcacmggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctraatggtgataaggctsaggcgctggaagtcttctgtgacatgacctctgatgggggtggatggattgtgttcctgagacgcaaaaacggacgygagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaa

SEQ ID NO: 503 - DNA, 7849 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctsaagaaagtcatccggcacaagcgacagagtggggtgaacgccaccctgccagaagagaaccagccagtggtgtttaaccacgtttacaacatcaagctgccagtgggatcccagtgttcrgtggatctggagtcagccagtggggagaaagacctggcaccgccttcagagcccagcgaaagctttcaggagcacacagtrgatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtraatggagtctgcatctgtttcgaaggctacgccggggctgactgcagccgtgaaatctgcccagtgccctgcagtgaggagcacrgcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccrgggtcgctgtgtgaatgggcagtgcrtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacartgcrtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccrggagctggarcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagrcattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagmgggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggaygagaaccagtactccatcgggaacctgaagcctgacactgagtacgaggtgtccctcrtctcccgcagaggtgacatgkcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcarttacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacrtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcrgaacctcaccgtgcctggcagmcttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacrttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacracagaggccctgccccttctggaaaacctaaccatttccgacattaatccctacgggttcacagtttcctggatggcatcggagaatgcctttgacagctttctagtaacggtggtggattctgggaagctgytggacccccaggaattcacactttcaggaacccagaggaagctggagcttagaggcctcataactggcattggctatgaggttatggtctctggcttcacccaagggcatcaaaccaagcccttgagggctgagattgttacagaagcmgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacwtaacaggtctcagagaggctactgaatacgaaattgaactctatggaataagcaaaggaaggcratcccagacagtcagtgctatagcaacaacagccatgggctccccaaaggaagtcattttctcagacatcactgaaaattcggctactgtcagctggagrgcacccacrgcccaagtggagagcttccgrattacctatgtgcccattacaggaggtacaccctccatggtaactgtggacggaaccaagactcagaccaggctggtgaaactcatacctggcgtggagtaccttgtcagcatcatcrccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagrgacttgactgctactgaggttcagtcggaaactgccctccttacctggcgacccccccgggcatcagtcacmggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctraatggtgataaggctsaggcgctggaagtcttctgtgacatgacctctgatgggggtggatggattgtgttcctgagacgcaaaaacggacgygagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaa

SEQ ID NO: 504 - DNA, 7284 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctsaagaaagtcatccggcacaagcgacagagtggggtgaacgccaccctgccagaagagaaccagccagtggtgtttaaccacgtttacaacatcaagctgccagtgggatcccagtgttcrgtggatctggagtcagccagtggggagaaagacctggcaccgccttcagagcccagcgaaagctttcaggagcacacagtrgatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtraatggagtctgcatctgtttcgaaggctacgccggggctgactgcagccgtgaaatctgcccagtgccctgcagtgaggagcacrgcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccrgggtcgctgtgtgaatgggcagtgcrtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacartgcrtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccrggagctggarcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagrcattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagmgggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggaygagaaccagtactccatcgggaacctgaagcctgacactgagtacgaggtgtccctcrtctcccgcagaggtgacatgkcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcarttacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacrtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcrgaacctcaccgtgcctggcagmcttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacrttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacracagaggccctgccccttctggaaaacctaaccatttccgacattaatccctacgggttcacagtttcctggatggcatcggagaatgcctttgacagctttctagtaacggtggtggattctgggaagctgytggacccccaggaattcacactttcaggaacccagaggaagctggagcttagaggcctcataactggcattggctatgaggttatggtctctggcttcacccaagggcatcaaaccaagcccttgagggctgagattgttacagaagcmgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacwtaacaggtctcagagaggctactgaatacgaaattgaactctatggaataagcaaaggaaggcratcccagacagtcagtgctatagcaacaacagccatgggctccccaaaggaagtcattttctcagacatcactgaaaattcggctactgtcagctggagrgcacccacrgcccaagtggagagcttccgrattacctatgtgcccattacaggaggtacaccctccatggtaactgtggacggaaccaagactcagaccaggctggtgaaactcatacctggcgtggagtaccttgtcagcatcatcrccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagrgacttgactgctactgaggttcagtcggaaactgccctccttacctggcgacccccccgggcatcagtcacmggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctraatggtgataaggctsaggcgctggaagtcttctgtgacatgacctctgatgggggtggatggattgtgttcctgagacgcaaaaacggacgygagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatatttgttttagaaccagccgtattttacatgaagctgtataattaattgtcattatttttgttagcaaagattaaatgtgtcattggaagccatc

SEQ ID NO: 505 - DNA, 1678 bp, Homo sapiens
ggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggaaagtctttgggttcggaggrttccagaaacatgaaggagaagttggaggacatggagagtgtcctcaaggacctgacagaggagaagagaaaagatgtgctaaactccctcgctaagtgcctcggcaaggagratattcggcaggatctagagcaaagagtatctgaggtcctgatttccrgggagctacacatggaggacycagacaagcctctcctaagcagcctttttaatgctgctggggtcttggtagaagcgygtgcaaaagccattctggacttcctggatgccctgctagsgctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagcyctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaattttg

SEQ ID NO: 506 - DNA, 1651 bp, Homo sapiens
ggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgagaaagtctttgggttcggaggrttccagaaacatgaaggagaagttggaggacatggagagtgtcctcaaggacctgacagaggagaagagaaaagatgtgctaaactccctcgctaagtgcctcggcaaggagratattcggcaggatctagagcaaagagtatctgaggtcctgatttccrgggagctacacatggaggacycagacaagcctctcctaagcagcctttttaatgctgctggggtcttggtagaagcgygtgcaaaagccattctggacttcctggatgccctgctagsgctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagcyctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaattttg

SEQ ID NO: 507 - DNA, 1690 bp, Homo sapiens
ggcaggaacaaatcacaatggtggaatgtcatcagttaaggctattttcatttcttttgtggatcttcagttgcttcaggccatctggatgtatacatgcaggtcacagggaatatgatggcttagcttgggttcagaggcctgacacctcaggctgccaaatgtggaagatttaaatacttgaaccaataccctcctcccaaaaactgaaattggcttctgtttctgagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgartattcatttcaggggcaaaacaaaatcctttccagaaggaaagtctttgggttcggaggrttccagaaacatgaaggagaagttggaggacatggagagtgtcctcaaggacctgacagaggagaagagaaaagatgtgctaaactccctcgctaagtgcctcggcaaggagratattcggcaggatctagagcaaagagtatctgaggtcctgatttccrgggagctacacatggaggacycagacaagcctctcctaagcagcctttttaatgctgctggggtcttggtagaagcgygtgcaaaagccattctggacttcctggatgccctgctagsgctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagcyctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaattttg

SEQ ID NO: 508 - DNA, 1470 bp, Homo sapiens
gcgcggcggcgcagtraacagtctccttccacaaaaccatggcgtcgctcaaatgtagyaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttmaggtggcaagtcctttatggagagaaaacttgacattcagatgattgtttttaaatgttttacttttggtacagttgatagacatcataaacgatatcaagcttacacttcatatggagttaaacttggkcagtgttaataaaatcaaaacgtgattctactgtacattgcattattcataatttaattgtttgaaattacattaaataaatcaactaattaaatactaaagttttgttcctttttaaaggaaataaccacaagatttttcccagcccaaattccagcgccaattttaggccaactttggctgttttcttccaaaagtgcttatgtggaattgggatccccagtgtagtgacagacagtcatgactgctgctgagtttgatctgtgaaggtagtgaaatgtggccctgatgtttcttaaccctgatttggtaactaccagccctgacaccatcagtgcttgatgtagcctggaaccccaggcccactgacgcactgggcacggggctctgggtcgaaggctggagccgtcactgttgttcatgtgcatttggagcactgtgggaatagtctggcagctgtgtgctgattaaatgtctttggcaaggcagggggcaggaaaaggccttgtggaaacaaaggcaccaaggatcaccccagcccagtgaaggcagaagaggtcacgtggatcagcctgtgtctttccagcagaatctgattaaagcctgtaatgctgtagggtgaaggttcagggcagatgtcagcatac

SEQ ID NO: 509 - DNA, 5465 bp, Homo sapiens
  misc_feature (1)...(5465): n = A,T,C or G, or insertion/deletion polymorphism (see Tables 1-2)
ttatatccgtggtttcctgctacctccaaccatgggccttttkggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattycaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtsaaagaactgtcatactacagtttagaagatttaaacaacaagtacctttatattgctgtaacagtcatagagtctacaggtggattttctgaagaggcagaaatacctggcatcaaatatgtcctctctccctacaaamtgaatttggttgctactcctcttttcctgaagcctgggattccatatcccatcaaggtgcaggttaaagattcgcttgaccagttggtaggaggrgtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccrgggaaggttaccgagcaatagcatactcatctctcagccaaagttacctttatattgattggactgataaccataaggctttgctagtgggagaacatctgaatattattgttacycccaaaagcccatatattgayaaaataactcactataattacttgattttatccaagggcaaaattatccaytttggcacgagggagaaattttcagatgcatcttatcaaagtataaacattccagtaacacagaacatggttccttcatcccgacttctggtctattanatcgtcacaggagaacagacagcagaattagtgtctgattcagtctggttaaatattgaagaaaaatgtggcaaccagctccaggttcatctntctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcnttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggyggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgartatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtakttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcrgtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaa

SEQ ID NO: 510 - DNA, 3755 bp, Homo sapiens
ctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctackccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgtccactaataaagagtcaagaaaaagcttggcttcattcccaacctacgttgaagttccgggaccctgcgaccccgaagacttgatcratggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaagrctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttygyatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccaggag

SEQ ID NO: 511 - DNA, 3814 bp, Homo sapiens
ctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctackccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgtccactaataaagagctacaaattctactactggtggaagcaggggtgaatttttttctcttatctcagtcagttcaagaaaaagcttggcttcattcccaacctacgttgaagttccgggaccctgcgaccccgaagacttgatcratggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgcttttttttttttttttttttcaataccagggaagtttygyatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccatttgcatatcacccttccctgctcccaccaccagtgagacaagctgaagattaggcacacagatcccctggaaacccacctctctggaaggccccttccctggcaggtggccaggcaggcgggggctgctcagcctcatcctgagagacctgccctctctgcgctgaggcccagcccctccagcaccactttggcttaaagcatcctcctcctggactcccctccctgccgaacacacatcccaggar

SEQ ID NO: 512 - DNA, 848 bp, Homo sapiens
gagagagggaggagcaggcaggatcctggagctccctggatttcaagctggccgtggcctcccgggtgacgtcactgcggtcattgcctgatgagctcaggcagaggcgcctggggacggggctgctcctctgtcgagctgatcrcacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggcctttgccaaccccgaggatgccctgagacacggaggcccccagtattgcaggagygaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctktgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccgtgtgtgtgtatgtgwgtgttgttttctcctagacccgtgacctgaga

SEQ ID NO: 513 - DNA, 916 bp, Homo sapiens
gagagagggaggagcaggcaggatcctggagctccctggatttcaagctggccgtggcctcccgggtgacgtcactgcggtcattgcctgatgagctcaggcagaggcgcctggggacggggctgctcctctgtcgagctgatcrcacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggcctttgccaaccccgaggatgccctgagacacggaggcccccagtattgcaggagygaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctwtgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccgtgtgtgtgtatgttgtgtgtgtgtgtgtgtgtgtgttttctcctagacccgtgacctgagatgtgtgatttttagtcattaaatggaagtgtctgccagctgggcccagcacctc

SEQ ID NO: 514 - DNA, 1898 bp, Homo sapiens
gagagagggaggagcaggcaggatcctggagctccctggatttcaagctggccgtggcctcccgggtgacgtcactgcggtcattgcctgatgagctcaggcagaggcgcctggggacggggctgctcctctgtcgagctgatcrcacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggcctttgccaaccccgaggatgccctgagacacggaggcccccagtattgcaggagygaccccgacgtggaacgctgcctcaggcaggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccgtgtgtgtgtatgtgwgtgtgkatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatccygggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctrccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgkgaggggcccacaggaagctcagccttctcctcccaaggtttgagtccctccaaagggcwgtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 515 - DNA, 1774 bp, Homo sapiens
gctgctcctctgtcgagctgatcrcacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggcctttgccaaccccgaggatgccctgagacacggaggcccccagtattgcaggagygaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccgtgtgtgtgtatgtgwgtgtgkatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatccygggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctrccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgkgaggggcccacaggaagctcagccttctcctcccaaggtttgagtccctccaaagggcwgtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 516 - DNA, 1895 bp, Homo sapiens
gagagagggaggagcaggcaggatcctggagctccctggatttcaagctggccgtggcctcccgggtgacgtcactgcggtcattgcctgatgagctcaggcagaggcgcctggggacggggctgctcctctgtcgagctgatcrcacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggcctttgccaaccccgaggatgccctgagacacggaggcccccagtattgcaggagygaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccgtgtgtgtgtatgtgwgtgtgkatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatccygggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctrccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgkgaggggcccacaggaagctcagccttctcctcccaaggtttgagtccctccaaagggcwgtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 517 - DNA, 1805 bp, Homo sapiens
gctgctcctctgtcgagctgatcacacccacagttgagctgcgctggccagagatgcctgcccacagcctggwgatgagcagcccggccctcccggcyttcctgctctgcagcacgctgctggtcatcaagatgtacgtggtggccatcatcacgggccaagtgaggctgcggaagaaggcctttgccaaccccgaggatgccctgagacacggaggcccccagtattgcaggagygaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctktgaccagcagckgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgtgtgtgcccttgtgagtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatccygggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctrccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgkgaggggcccacaggaagctcagccttctcctcccaaggtttgagtccctccaaagggcwgtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgccagctgggcccagcacctaaaaaaaaaaaaaaaaaaa

SEQ ID NO: 518 - DNA, 9941 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccragacttaggattgattttatctttagtctcctaagtaaatatgctactggtataaggtayaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcrtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaamggagtctcttcatgtaccaatgctttgtaccacttagccatcaaattgacatcatctgttttgcagatggcatttgatgagctgagaaggcagcgtgcattttcactaaaagaaygtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccataycatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgracrtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacmccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttmatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctsgttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatktagcagcygctatcagaaatctaggatttttcatctcagtgtccctcagattcatgttaatcttgataagaaggcrgtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcagttcaaaagaaatagaagactttcagtcaacygagtctgtcagtagccagcagatgaacctcagtattggtgatgacagcactggtagctggtccaatttaagttttgaagatgaacaccaagatgaaagcagcagttttcatcatctaagtgaaagtaatggtaacagcagtagctggagcagtcttggtttagaaggagatttgtatgaggacaatttatcctttccracatcagacagtgatggaccagatgataaagatgaagagcatgaggacgaagtagaaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctactttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttctttcctgcttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggggtgtgtgtgtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatrtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttyctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctggtcttggtt

SEQ ID NO: 519 - DNA, 1072 bp, Homo sapiens
aactaaaaagctcaagggagaattagccaaagagtttgcacctgctacmccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttmatgttttcaaacaaagagcaccaccaagaagcagacaaaaagagacaaagtaaaagaaatgaaggttacttttgtaaaaatcaaacttcatattgctggtttcaggcatgtgtggaaaggacctgtggaccatcagttgaacttagcccctggaaatggcaaactaggtgtgggagggaaggcaactcttggaaaagggaa

SEQ ID NO: 520 - DNA, 855 bp, Homo sapiens
  misc_feature (1)...(855): n = A,T,C or G, or insertion/deletion polymorphism (see Tables 1-2)
gcgtgacagagcgctttacgacagttgctttgaggcagtaccggaggagaaagatggcggctaccttactagctgctcggggagccgggccagcaccggcttgggggccggaggcrttcactccagactgggaaagccgagaagtttccactgggaccactatcatggccgtgcagtttgacgggggcgtggttctgggggcggactccagaacaaccacygggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagsctccactggtccacacagcagccagyctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctancgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctkaatcctgggattytagtatgcaataagagatgccctgtactgatgcaaaatttaataaagtttgtcacagagaatctttgtac

SEQ ID NO: 521 - DNA, 2589 bp, Homo sapiens
  misc_feature (1)...(2589): n = A,T,C or G, or insertion/deletion polymorphism (see Tables 1-2)
cagacacggtcgcctccacatccaggtctttgtgctcctcgcttgcctgttccttttccacgcattttccaggataacttccttgcttccaggccckcaatggatgccctgcaactagcaaattcggcttttgcygttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctahaaatcamcaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacmtgcattgtaaatagsttcttcttgttctgagattcaatattgaatttttcctatgctattgacaataaaatattattgaactac

SEQ ID NO: 522 - DNA, 2593 bp, Homo sapiens
  misc_feature (1)...(2593): n = A,T,C or G, or insertion/deletion polymorphism (see Tables 1-2)
cagacacggtcgcctccacatccaggtctttgtgctcctcgcttgcctgttccttttccacgcattttccaggataacttccttgcttccaggccckcaatggatgccctgcaactagcaaattcggcttttgcygttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggcaagccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctahaaatcamcaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacmtgcattgtaaatagsttcttcttgttctgagattcaatattgaatttttcctatgctattgacaataaaatattattgaactac

SEQ ID NO: 523 - DNA, 2635 bp, Homo sapiens
  misc_feature (1)...(2635): n = A,T,C or G, or insertion/deletion polymorphism (see Tables 1-2)
ggcagtgggcgtggcggtgctgcccaggtgagccaccgctgcttctgcccagacacggtcgcctccacatccaggtctttgtgctcctcgcttgcctgttccttttccacgcattttccaggataactgtgactccaggccckcaatggatgccctgcaactagcaaattcggcttttgcygttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctahaaatcamcaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacmtgcattgtaaatagsttcttcttgttctgagattcaatattgaatttttcctatgctattgacaataaaatattattgaactac

SEQ ID NO: 524 - DNA, 796 bp, Homo sapiens
cagacacggtcgcctccacatccaggtctttgtgctcctcgcttgcctgttccttttccacgcattttccaggataacttccttgcttccaggccckcaatggatgccctgcaactagcaaattcggcttttgcygttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggcaagccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaaggtatgtggggcagcrtgtagcagtaaaaggagcccaattatagatgtgaaaaatgayagggacagagtggggcataaatccattccaatgaggaacctgagggcacggccggcaaagtgcctttcc

SEQ ID NO: 525 - DNA, 2566 bp, Homo sapiens
  misc_feature (1)...(2566): n = A,T,C or G, or insertion/deletion polymorphism (see Tables 1-2)
ggcacgagttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttcaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctahaaatcamcaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccrtgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 526 - DNA, 870 bp, Homo sapiens
gaagcaatytgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatayaccttctgagacagaaggttctgtttttatggaaactcaaatgctgccttagaaatcactcctagatgaaatgtttctcataataacttgtcaagaactttttagagttgttacataaaaataattgctgtgtagctttcagtct

SEQ ID NO: 527 - DNA, 4342 bp, Homo sapiens
  misc_feature (1)...(4342): n = A,T,C or G, or insertion/deletion polymorphism (see Tables 1-2)
cagggcggcgggagaccccgggtgaacggggaagggacatttagtttgagacggtgctgagataggatcatgaaggaagaggtgaagggaattcctgtaagagtggcactgcgttgtcgccctctggtccccaaagagattagcgagggctgccagatgtgcctttccttcgtgcccggggagactcaggtggtggttggtactgataaatccttcacctacgattttgtgtttgacccctgtactgagcaggaagaagtcttcaataaagcagtagcgccgctcataaaaggcatatttaaaggatataatgcaacggtcctggcctatgggcagactggctctggaaaaacctattcaatgggaggtgcatacactgcggagcaggagaatgaaccaacagttggcattattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgggaggatcctaaggaaggcataaagattgtgggactcactgagaagactgttttagttgccttggatactgtttcctgtttggagcagggcaacaactctaggactgtggcctccacagctatgaactcccagtcgtcccgatctcatgccatctttacaatctccatagagcaaagaaagaaaagtgacaagaattgcagctttcgctccaagctgcatcttgtagatctcgctggatcagaaagacagaagaaaaccaaggctgaaggggatcgtctaaaagagggtattaatattaaccgaggcctcctatgcttgggaaatgtaatcagtgctcttggagatgacaaaaagggtagctttgtgccctacagagattccaagttaactcgactgctgcaagattctctaggaggtaacagccacactcttatgatagcctgtgtgagtcctgctgactccaatctagaggaaacattaagtacccttcgctatgctgacagagcaagaaaaatcaagaacaaacctattgttaatattgatccccacacagctgaacttaatcatctaaagcaacaggtacaacagctacaagtcttgttgctacaagcccatggaggtaccctgcctggatctataaatgcagaaccatcagagaatctacartccctgatggagaagaatcagtccctggtagaggagaatgaaaaattaagtcgttgtctgagcaaggcagctggtcagacagcccagatgttggagaggatcattttgacagagcaagtgaatgaaaaactgaacgccaagctagaagagctcaggcagcatgtggcctgcaagctggatcttcaaaagctagtggagactttggaagaccaggaattgaaagaaaatgtagagataatttgtaacctgcagcaactgattacccagttatcagatgaaactgttgcttgcacggctgcagccattgatactgcggtagaasaagaagctcaagtggaaaccagtccagagacaagcaggtcttctgacgcttttaccactcagcatgctctccatcaagctcagatgtctaaggaggtggttgagttgaataacgcccttgcactgaaagaggccctagttaggaagatgactcagaacgacaaccaactacagcccattcagtttcaataccaggataacataaaaaatctagaattagaagtcatcaatctgcaaaaggaaaaggaagaattggttcntgaacttcagacagcaaagaagaatgtcaaccaagccaagctgagtgagcaccgccacaaacttctccaggagctggagggtcaaatagctgatctgaagaagaaactgaatgagcagtccaaacttctgaaactaaaggaatccacagagcgtactgtctccaagctgaaccaagagatatggatgatgaaaaaccagcgggtacagttaatgcgtcaaatgaaagaggatgctgagaagtttagacaatggaagcagaaaaaagacaaagaagtaatacagttgaaagaacgagaccrtaagaggcaatrtgagctgctcaaacttgaaagaaacttccagaaacaatccagtgtgctcagacgtaaaacggaagaggcagcagctgccaacaagcgactcaaggatgctctccagaaacaacgagaggtcacagataagcggaaagagactcagagccatggaaaggaaggtattgcagctcgagtgaggaattggcttggaaatgaaattgaggttatgrtcagtactgaggaagccaaacgccatctgaatgacctccttgaagacagaaagatcctggctcaggatgtggttcaactcaaagaaaaaaaggaatctcgggagaatccacctcctaaactccggaagtgtacattctccctttctgaggtgcatggtcaagttttggagtcagaagattgtattacaaaacagattgaaagcctagagactgaaatggaactcaggagtgctcagattgctgacctacagcagaagctgctggatgcagaaagtgaagataggccaraacaatgctgggagaatattgccaccattctggaagccaagtgtgccctgaaatatttgattggagagctggtctcctccaaaatacatgtcaccaaacttgaaaacagcctgagacagagcaaggccagctgtgctgacatgcagaagatgctatttgaggaacaaaatcatttttctgagatagagacagagttacaagctgagctggtcagaatggagcaacagcaccmagagaaggtgctataccttgtcagccagctgcaggaaagccaaatggcagagaagcagttagagaaatcagccagtgaaaaggaacaacagctggtgagcacactgcagtgtcaggatgaagaacttgagaagatgcgagaagtgtgtgagcaaaatcagcagcttctccaagagaatgaaatcatcaagcagaaactgatcctcctccaggtagccagcagacagaaacatcttcctaatgatacccttctatctccagactcttcttttgaatatatcccacctaagccaaaaccttctcrtgttaaagaaaagtttctggagcaaagcatggacatcgaggatctaaaatattgttcagagcattctgtgaatgagcatgaagatggtgatggtgatggcgacagtgatgagggggatgatgaggaatggaagccaacaaaattagtcaaggtgtccaggaagaacatccaagggtgttcctgcaagggctggtgtgggaacaagcagtgtgggtgcaggaagcaaaagtcagactgtggtgtggactgtagctgtgaccccacaaagtgtcggaaccgccagcaaggcaaggatagcttgggcactgttgaacagacccaggattccgaaggctccttcaaactggaggatcctaccgaggtgaccccaggattgagcttctttaaccctgtctgtgccacccccaatagcaagatcctgaaagagatgtgtgacatggagcaggtgctgtcaaagaagactgctccagctccctccccttttgacctcccagagtcgaaacatggagcaacagaataccaacaaaataagcctccagggaagaaaaagaaacgagctctggctagcaacaccagcttcttctctggctgctcccctatcgaagaagaggcccactgaagttggagtcatcatctctacscccaatctggcttgggagatgctttccagttgcagccagaaggggttttttaaatgacttctctggatttcaggtttcttgccgttgaaaaaaaggaacaaagcattactaaaaagaaggtaacctttgttggatgttgtccctcagtctccatccccagactactgctctctgctctctagaaggctgctaaaccacctgctgaagagagaaccaacagactttcctaatgactcatcaggaaccagtcctcagtatgatcaagttccttcttatttgtgagcagttcaggctatctcctgatggggatgaggccaaggctttcttatcttttggttgtctctgcttaatggaggagcctggcctaggatggaggtctggctcagatctttcactccacctcgggaatggggttgtgatctttcctgtcctgaccccctctgaattgtaagtgtttcaatagtactcttgattgtatgccatgttgttgaagtaaatgaattatttttaaatgttaagtaaataaaccttagcccatctactgtt

SEQ ID NO: 528 - DNA, 2652 bp, Homo sapiens
  misc_feature (1)...(2652): n = A,T,C or G, or insertion/deletion polymorphism (see Tables 1-2)
gtctacaccagcggtgtcgctgcccgaaagtgagagaaggctgataytgctagctggaatccaggcctgggtgctgcatggtggcgcccctccccgtgaccaccgctgcgttttctcgggctttctctggggagctgctcttgtgctgtttggcccctgcctactcggaatggaacaaagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaartggatgaaaacaacggacttttgmttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcytgcttttgcccgtggatggtggttgctccatgagcctccatctgattggctggagaggctgtgccaggcagacctcrtttacatcagtcatctgmactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatgganggtgttcatcctgagatggacacttgcattattgtggagtacaaaggtcataaaatactcaatayagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcytgaactacaaggctnggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcsaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcartccttttcctggaggatatgactatttggttgactttttagatttatccttcccaaaagaaagaccacaacgagaacatccctatgaggaaatcyatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgngattttgcaagantgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggaycactacatagccagattcaaaaatattttacttsttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcantgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatgaatttt

SEQ ID NO: 529 - DNA, 2691 bp, Homo sapiens
  misc_feature (1)...(2691): n = A,T,C or G, or insertion/deletion polymorphism (see Tables 1-2)
tgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctggggagctgctcttgtgctgtttggcccctgcctactcggaatggaacaaagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaartggatgaaaacaacggacttttgmttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcytgcttttgcccgtggatggtggttgctccatgagcctccatctgattggctggagaggctgtgccaggcagacctcrtttacatcagtcatctgmactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatgganggtgttcatcctgagatggacacttgcattattgtggagtacaaaggtcataaaatactcaatayagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcytgaactacaaggctnggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcsaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcartccttttcctggaggatatgactatttggttgactttttagatttatccttcccaaaagaaagaccacaacgagaacatccctatgaggaaatcyatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgngattttgcaagantgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggaycactacatagccagattcaaaaatattttacttsttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcantgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatgaatttt

SEQ ID NO: 530 - DNA, 2588 bp, Homo sapiens
  misc_feature (1)...(2588): n = A,T,C or G, or insertion/deletion polymorphism (see Tables 1-2)
ctgcggcgagagaatctccaactcatggaggctgagcttctgcgggagaggccacagcctgaagaagaggtgggatcggaaataaacccgcctgggagacctgcaggcaccagcagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaartggatgaaaacaacggacttttgmttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcytgcttttgcccgtggatggtggttgctccatgagcctccatctgattggctggagaggctgtgccaggcagacctcrtttacatcagtcatctgmactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatgganggtgttcatcctgagatggacacttgcattattgtggagtacaaaggtcataaaatactcaatayagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcytgaactacaaggctnggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcsaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcartccttttcctggaggatatgactatttggttgactttttagatttatccttcccaaaagaaagaccacaacgagaacatccctatgaggaaatcyatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgngattttgcaagantgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggaycactacatagccagattcaaaaatattttacttsttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcantgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatgaatttt

SEQ ID NO: 531 - DNA, 6073 bp, Homo sapiens
  misc_feature (1)...(6073): n = A,T,C or G, or insertion/deletion polymorphism (see Tables 1-2)
ctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcgggttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggrgcgacaacagcatcagggcattcttagcagggttacagaatctgttaagaatattgtgccagggtggytacaaagatmcttcaacaagaatgaagatgtatgcagctgttcaacagacacaagcgaggttccacgctggccagaaaataaagaggaccatctggtatatgccratgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccrgaagctgaacgttctcactcactctcacagcacactgccaccagctcaaaaaaaccagcattcaacttgtctgcctttggaacactttccccttcacttgggaattcttcartccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacartcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataasaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcmgaaatcctgaaagaaggaagtgttctwgatattctgaaaagccctggtttcgcatcgccgaagatagattctgttgctgctcagcccacygcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctrcttcaagtagcagcactgtacctgtctstctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatcngattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaaygtggagcctgcctctctgccatctgcctcagtgtttgttttgggaaggacagaagagaaacagcaagagcctgtcacttcyacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatrgaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttggaaatctttaaaaaaaaaattggggattcttaaagttgaatttattggcttttctga

SEQ ID NO: 532 - DNA, 6399 bp, Homo sapiens
  misc_feature (1)...(6399): n = A,T,C or G, or insertion/deletion polymorphism (see Tables 1-2)
ctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcgggttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggrgcgacaacagcatcagggcattcttagcagggttacagaatctgttaagaatattgtgccagggtggytacaaagatmcttcaacaagaatgaagatgtatgcagctgttcaacagacacaagcgaggttccacgctggccagaaaataaagaggaccatctggtatatgccratgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccrgaagctgaacgttctcactcactctcacagcacactgccaccagctcaaaaaaaccagcattcaacttgtctgcctttggaacactttccccttcacttgggaattcttcartccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacartcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataasaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcmgaaatcctgaaagaaggaagtgttctwgatattctgaaaagccctggtttcgcatcgccgaagatagattctgttgctgctcagcccacygcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctrcttcaagtagcagcactgtacctgtctstctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatcngattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaaygtggagcctgcctctctgccatctgcctcagtgtttgttttgggaaggacagaagagaaacagcaagagcctgtcacttcyacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatrgaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaa

SEQ ID NO: 533 - DNA, 5893 bp, Homo sapiens
  misc_feature (1)...(5893): n = A,T,C or G, or insertion/deletion polymorphism (see Tables 1-2)
ttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggrgcgacaacagcatcagggcattcttagcagggttacagaatctgttaagaatattgtgccagggtggytacaaagatmcttcaacaagaatgaagatgtatgcagctgttcaacagacacaagcgaggttccacgctggccagaaaataaagaggaccatctggtatatgccratgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccrgaagctgaacgttctcactcactctcacagcacactgccaccagctcaaaaaaaccagcattcaacttgtctgcctttggaacactttccccttcacttgggaattcttcartccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacartcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataasaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcmgaaatcctgaaagaaggaagtgttctwgatattctgaaaagccctggtttcgcatcgccgaagatagattctgttgctgctcagcccacygcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctrcttcaagtagcagcactgtacctgtctstctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatcngattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaaygtggagcctgcctctctgccatctgcctcagtgtttgttttgggaaggacagaagagaaacagcaagagcctgtcacttcyacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatrgaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaa

SEQ ID NO: 534 - DNA, 6375 bp, Homo sapiens
agctgaagacccggccgcccagatgatgcggtggtgggggacctgccggcacgcgactccccccgggcccaaattgatattcactgatggactccaaagaatcattaactcctggtagagaagaaaaccccagcagtgtgcttgctcaggarargggagatgtgatggacttctataaaaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaarttggartaggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacayctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggayggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcataatwaaaaaatctgctttttca

SEQ ID NO: 535 - DNA, 6860 bp, Homo sapiens
cggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggarargggagatgtgatggacttctataaaaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaarttggartaggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacayctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggayggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcataatwaaaaaatctgctttttca

SEQ ID NO: 536 - DNA, 782 bp, Homo sapiens
gaggctcctctcctagaccctgcatcctgaaagctgcgtacctgagagcctgckgtctggctgcagggacacacccargggraggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaagggtgcaacatagaaaatgcctgctacccrctgggcatctgtgctgaacggaccgctatccagaaggccgtctcagaagggtacaaggatttcagggcaattgctatcgccagtttggcaccaactggcccgtgtacatgaccaagccggatggtacgtatattgtcatgacggtccaggagctgctgccctcctcctttgggcctgaggacctgcagaagacycagtgacagccagagaatgcccactgcctgtaacagccacctggagaayttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctct

SEQ ID NO: 537 - DNA, 951 bp, Homo sapiens
gaggctcctctcctagaccctgcatcctgaaagctgcgtacctgagagcctgckgtctggctgcagggacacacccargggraggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaagggtgcaacatagaaaatgcctgctacccrctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacycagtgacagccagagaatgcccactgcctgtaacagccacctggagaayttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaagc

SEQ ID NO: 538 - DNA, 2415 bp, Homo sapiens
  misc_feature (1)...(2415): n = A,T,C or G, or insertion/deletion polymorphism (see Tables 1-2)
gtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgacygacctgttcatccgcttcccagagaatctcttgctacaccgggtggagaacacccagggccacatcctctatgctttcttggtggagaacaaggaacgagaaagtcgagtggtgcactttgctgtgctcaaggcggagacagncacctctgtggccaagatgctgagcatcttcacagagttcaactccgattggcccaaggtcaaggtggtctttgtggacccttcattccattacygggctatcctgcaggagatctttcctgctgcccgcatcctcctttccatctaccacacaacccgactcttggagaagaagttgcatcgtagttcagcaaatccatcctttaaaaggctcatgaaggaagccctgcgggargccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgngaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagaygcacagcaggtacaggtacagcagcagtcacaagtgccrccctcgcaggttggcatgctggacaccttgcaccagagtggctctgaactagcctacaagctgtgccacaatgagtgggaggtggtacagaactccacccacctggtggacatggctggctcttcagtggacgttcagctgctagaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaagaaggggagggattccctcctgctacagctgtgatgcattattgaagcactttagctgaagcaytggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaagatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaaggg

SEQ ID NO: 539 - DNA, 2780 bp, Homo sapiens
  misc_feature (1)...(2780): n = A,T,C or G, or insertion/deletion polymorphism (see Tables 1-2)
aagatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgacygacctgttcatccgcttcccagagaatctcttgctacaccgggtggagaacacccagggccacatcctctatgctttcttggtggagaacaaggaacgagaaagtcgagtggtgcactttgctgtgctcaaggcggagacagncacctctgtggccaagatgctgagcatcttcacagagttcaactccgattggcccaaggtcaaggtggtctttgtggacccttcattccattacygggctatcctgcaggagatctttcctgctgcccgcatcctcctttccatctaccacacaacccgactcttggagaagaagttgcatcgtagttcagcaaatccatcctttaaaagtctcatgaaggaagccctgcgggargccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgngaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagaygcacagcaggtacaggtacagcagcagtcacaagtgccrccctcgcaggttggcatgctggacaccttgcaccagagtggctctgaactagcctacaagctgtgccacaatgagtgggaggtggtacagaactccacccacctggtggacatggctggctcttcagtggacgttcagctgctggaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaggaaggggagggattccctcctgctacagctgtgatgcattattgaagcactttagctgaagcaytggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaatatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaaggg

SEQ ID NO: 540 - DNA, 2928 bp, Homo sapiens
  misc_feature (1)...(2928): n = A,T,C or G, or insertion/deletion polymorphism (see Tables 1-2)
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaanaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 541 - DNA, 2751 bp, Homo sapiens
  misc_feature (1)...(2751): n = A,T,C or G, or insertion/deletion polymorphism (see Tables 1-2)
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaanaggtcatgcccagatgtgcagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccaattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 542 - DNA, 2790 bp, Homo sapiens
  misc_feature (1)...(2790): n = A,T,C or G, or insertion/deletion polymorphism (see Tables 1-2)
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaanaggtcatgcccagatgtgcagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 543 - DNA, 2895 bp, Homo sapiens
  misc_feature (1)...(2895): n = A,T,C or G, or insertion/deletion polymorphism (see Tables 1-2)
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaanaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaagtggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccaattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 544 - DNA, 2932 bp, Homo sapiens
  misc_feature (1)...(2932): n = A,T,C or G, or insertion/deletion polymorphism (see Tables 1-2)
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactgggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaanaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaaggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 545 - DNA, 2928 bp, Homo sapiens
  misc_feature (1)...(2928): n = A,T,C or G, or insertion/deletion polymorphism (see Tables 1-2)
agttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcgggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactggtccacttctggtaattcatcctacagatatacttgcagggagggcaatgagccaggggagaccactcagatcacataccatcagcttctggtccaagtgtgtcagttcagcaatgttctccgaaaacagggcattcagaagggggaccgagtggccatctacatgcctatgatcccagagcttgtggtggccatgctggcatgtgcccgcattggggctttgcactccattgtgtttgcaggcttctcttcagagtctctatgtgaacggatcttggattccagctgcagtcttctcatcactacagatgccttctacaggggggaaaagcttgtgaacctgaaggagctggctgacgaggccctgcagaagtgtcaggagaagggtttcccagtaagatgctgcattgtggtcaagcacctggggcgggcagagctcggcatgggtgactccaccagccagtcccccccaattaanaggtcatgcccagatgtgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggagatgagcctgtcaccaagcatagccgggcatccttgcaggtgttaggcacagtgggtgaacccatcaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggtgaagctgaaggttatctggtgttcaagcagccctggccagggatcatgcgcacagtctatgggaaccacgaacgctttgagacaacctactttaagaagtttcctggatactatgttacaggagatggctgccagcgggaccaggatggctattactggatcactggcaggattgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccaattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaa

SEQ ID NO: 546 - DNA, 1590 bp, Homo sapiens
  misc_feature (1)...(1590): n = A,T,C or G, or insertion/deletion polymorphism (see Tables 1-2)
gagtgagtgagagggmagaggaaatactcaatstgtgccactcactgccttgagcctgcttcctcactccaggactgccagagggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaayaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggagragacaatggagaagaaggggaagaagaaagtgtcactggagccaatgcagaagrcaccacagagaccggarggcagggcaagggcacctcgaagacaacaacctctccaaatggtgggtttgaacctacaaccccaccacaagtctatagaaccacttccccaccttttgggaaaaccaccrccgttgaatacgagggggagtacgaatacacgggcgncaatgawtacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggakgaattcatccattctggctttgcatccggctaccattttcgaagttcaactcaggaaggtgcaatataacaaatgtgcatattataatgaggaatggtactaccgttccagattttctgtaattgcttctgcaragtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaatgtgttataatt

SEQ ID NO: 547 - DNA, 1566 bp, Homo sapiens
  misc_feature (1)...(1566): n = A,T,C or G, or insertion/deletion polymorphism (see Tables 1-2)
caatstgtgccactcactgccttgagcctgcttcctcactccaggactgccagaggtccagaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaayaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggagragacaatggagaagaaggggaagaagaaagtgtcactggagccaatgcagaagrcaccacagagaccggarggcagggcaagggcacctcgaagacaacaacctctccaaatggtgggtttgaacctacaaccccaccacaagtctatagaaccacttccccaccttttgggaaaaccaccrccgttgaatacgagggggagtacgaatacacgggcgncaatgawtacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggakgaattcatccattctggctttgcatccggctaccattttcgaagttcaactcaggaaggtgcaatataacaaatgtgcatattataatgaggaatggtactaccgttccagattttctgtaattgcttctgcaragtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaatgtgttataatt

SEQ ID NO: 548 - DNA, 1108 bp, Homo sapiens
  misc_feature (1)...(1108): n = A,T,C or G, or insertion/deletion polymorphism (see Tables 1-2)
gagtgagtgagagggcagaggaaatactcaatctgtgccactcactgccttgagcctgcttcctcactccaggactgccagaggctcactcccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaayaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggagragacaatggagaagaaggggaagaagaaagtgtcactggagccaatgcagaagrcaccacagagaccggarggcagggcaagggcacctcgaagacaacaacctctccaaatggtgggtttgaacctacaaccccaccacaagtctatagaaccacttccccaccttttgggaaaaccaccrccgttgaatacgagggggagtacgaatacacgggcgncaatgawtacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctg

SEQ ID NO: 549 - DNA, 3986 bp, Homo sapiens
gaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtcccygagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccayctctatgtcaaagaccctgcccggccctggaacgtgctagcacaggaggtggtcgtgttcgaggaccaggacgcactactgccctgtctgctcacagacccggtgctggaagcaggcgtctcrctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacacyaagctckcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcrcaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgaraagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactrtcagttctgctgaggagttgacgacagggagtaccactctcccctccymcaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctctyagtctctgccctatacgccgccttcactccacagcctcacccctcccacccccatactggtactgctgtaatgasccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgcmgtgggatgtctctgtccacattaaactaacagcattaatgca

SEQ ID NO: 550 - DNA, 3993 bp, Homo sapiens
gaagggcagacagagtgtccaaaagcgtgagagcacgaagtgaggagaaggtggagaagagagaagaggaagaggaagaggaagagaggaagcggagggaactgcggccaggtgcctagctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtcccygagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccayctctatgtcaaagaccctgcccggccctggaacgtgctagcacaggaggtggtcgtgttcgaggaccaggacgcactactgccctgtctgctcacagacccggtgctggaagcaggcgtctcrctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacacyaagctckcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcrcaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgaraagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactrtcagttctgctgaggagttgacgacagggagtaccactctcccctccymcaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctctyagtctctgccctatacgccgccttcactccacagcctcacccctcccacccccatactggtactgctgtaatgasccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgcmgtgggatgtctctgtccacattaaactaacagcattaatgca

SEQ ID NO: 551 - DNA, 5762 bp, Homo sapiens
  misc_feature (1)...(5762): n = A,T,C or G, or insertion/deletion polymorphism (see Tables 1-2)
caagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtcccygaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtrtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcycatgttttggttaaggaagctcccgggaattgtggtacagcagtcactaagacgccagtcgtcaaaagtggtgtgcagcctgaggtcactctggggacaactgacaatgacagtcctggagcagacktaccaacaccatcygaggggacaagtacctccagtccactccctgctcctaaaaaacctacaggagntgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtgataagactccctctgtgaggacttgtggtctgaagccaagcacactgaagcagytgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaaggggracaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgangagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccaygcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccrccttggggttgctcagatcaagacrgagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctsntagctggtgggttccgtggggcctgcngtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgtagcaggagtcaattccgtgcacatcgtatggggcacagtgtggtcaagctccacagctgtgagctcgtcacttcatgtgaaggagggaaggaaagaaagacgttccagggaatttgcaggtactcatgtggcacaaagaaccagaggctgactgcattaatgctgttagtttaatgtggacagagacatcccackgcgtgactgttagttaggatgagtcagcttgggggagtttgtgcttcctgcttggtgtggccagccacatgccaagaacagtaggggaggcggggggtgagggctcagcccccagcccctgactggcagtgatggcccatgctcaggaagtgggatcctctgacctcccctgaatccctcaccttccca

SEQ ID NO: 552 - DNA, 3551 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggcygagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgaaactcgaactatctaccagtttcattacaagaattggccagaccatgatgtaccttcatctatagaccctattcktgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccrggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtayggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggtatgtcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttytacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatmtagttcaactctaattttatgtagtaaataaattggcaggtaatygtttttacaaagaatccacctgacttcccctaatgcattaaaaatatttttatttaaataactttatttataacttttaraaacatgtagtattgtttaaacatcatttgttcttcagtatttttcatttggaagtccaatagggcaaattgaatgaagtattattatctgtctcttgtagtacaatgtatccaacagacactcaataaactttttggttgtt

SEQ ID NO: 553 - DNA, 3622 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggcygagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcktgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccrggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtayggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagactcctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttytacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatmtagttcaactctaattttatgtagtaaataaattggcaggtaatygtttttacaaagaatccacctgacttcccctaatgcattaaaaatatttttatttaaataactttatttataacttttaraaacatgtagtattgtttaaacatcatttgttcttcagtatttttcatttggaagtccaatagggcaaattgaatgaagtattattatctgtctcttgtagtacaatgtatccaacagacactcaataaactttttggttgt

SEQ ID NO: 554 - DNA, 1809 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggcygagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaaggaagctgaaaaaaggaaatctgattatataatcaggactctaaaagttaagttcaatagtgtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattttcttttacttttytacataaacataaacttcaaaaggtttgtaagatttggatctcaactaatttctacattgccagaatatactataaaaagttaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaaggaattcaactgaaatcctgataagttttaaccaaagtcattaaattaccaattctagaaaagtaatcaatgaaatataatagctatcttttggtagcaaaagatataaattgtatatgtttatacaggatctttcagatcatgtgcaatttttatctaaccaatcagaaatactagtttaaaatgaatttctatatgaatatggatctgccataagaaaatmtagttcaactctaattttatgtagtaaataaattggcaggtaatygtttttacaaagaatccacctgacttcccctaatgcattaaaaatatttttatttaaataactttatttataacttttaraaacatgtagtattgtttaaacatcatttgttcttcagtatttttcatttggaagtccaatagggcaaattgaatgaagtattattatctgtctcttgtagtacaatgtatccaacagacactcaataaactttttggttgt

SEQ ID NO: 555 - DNA, 2329 bp, Homo sapiens
gcatgctctgctcaggcggcagcagtggctttttggaggtgtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggcygagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcktgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccrggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtayggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcaggtaaaaatttctcttggctttagatgacatttagccctaagattggaagaatggttcgttaagtttagagtaattcacttcaggaagttacttggttcccataatagcttccagtattcattgatttatttctggctttcccagactagaaattttgtaaagag

SEQ ID NO: 556 - DNA, 3910 bp, Homo sapiens
  misc_feature (1)...(3910): n = A,T,C or G, or insertion/deletion polymorphism (see Tables 1-2)
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgmtgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccnacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgygaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacat

SEQ ID NO: 557 - DNA, 2542 bp, Homo sapiens
  misc_feature (1)...(2542): n = A,T,C or G, or insertion/deletion polymorphism (see Tables 1-2)
acgctccctttccactcctccactcagagccggggacgcggcgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgmtgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccnacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgygaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaaccacttctgtgtgatatgtacatattcaaacacattttttaac

SEQ ID NO: 558 - DNA, 3810 bp, Homo sapiens
  misc_feature (1)...(3810): n = A,T,C or G, or insertion/deletion polymorphism (see Tables 1-2)
gcctgcggagaaaagctgggaacggccgcttccggcatgttcatctctggacgaagaacggccgacaagtggagggcggaggagagactccaatgcccagcgggcagtgcgcgggcggcgcttgcgcgmtgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccnacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgygaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaaa

SEQ ID NO: 559 - DNA, 3494 bp, Homo sapiens
atgagtgaaaggagaagatctgcagtcgccctgagctcgcgagcacatgccttctccgttgaagccttgatcggctcaaataaaaaacggaaactgcgagactgggaggagaaggggctggacctgtctatggaggcgctgagccccgcgggcccactcggagacacggaggacgcggcggcacacggcctggagcctcacccggattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccamatcagcagtactacatagcaatggacattgtgcctgtggacaataaaagatayagrtatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcascacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcakgcacatgattagyccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgt

SEQ ID NO: 560 - DNA, 2684 bp, Homo sapiens
cctgaccagtgggtcactctcatggcagatgcctgggcagatttctgaagtggagcaagagaaatcttctcttcttcacctgcttcagggaggcatcaaagtgccaaaaaggggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctayaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgygaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggacttwattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgat

SEQ ID NO: 561 - DNA, 2572 bp, Homo sapiens
ggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctayaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgygaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggacttwattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgat

SEQ ID NO: 562 - DNA, 2668 bp, Homo sapiens
acccagcactaaggagcaccctgctctggtctccgccaccacccagcgcctcctggacccatccccccaaacccttgaacgtcctcaggacccccaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctayaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgygaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggacttwattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgat

SEQ ID NO: 563 - DNA, 2213 bp, Homo sapiens
cctgaccagtgggtcactctcatggcagatgcctgggcagatttctgaagtggagcaagagaaatcttctcttcttcacctgcttcagggaggcatcaaagtgccaaaaaggggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctayaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgygaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaatggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggacttwattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgat

SEQ ID NO: 564 - DNA, 2219 bp, Homo sapiens
aggcgtgtggggcaggaccagtccttcagcggccgggttcgcgccgcggtcgccggytgmttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccrgccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattagcctttgctggaggcataaaagaaggacaggcgtacctcggagatatcacagatctaagctggaaccagaaccaaatacaaagacaagagaatccacatcttctgmgaaagtttcacagagtccttcaaaagactctgaagaaaaccctgccactgaagaacgtccagaaaaaattttggctgaaacacaacctgaattgggaacgtggggagatggcaaaggcgaagatgagttawccccagaagaaatacaaatgtttgaacaggaaaatcagcgactaattggtgaaatgaacagcttgtttgatgaagtgagggtagcccatgctgcccctgacaccaggaagatggctagcccaagtgtttcagatccgacagaacactccgttgccaaaccaagacatggcattttctaaatgaatcagaggagcttttttcttggaacagggagttggtttgaaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagaygtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcckcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattattactcctccaaagactgctgcccccagarcaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgg

SEQ ID NO: 565 - DNA, 369 bp, Homo sapiens
accagtccttcagcggccgggttcgcgccgcggtcgccggytgmttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccrgccgggcccgcgaagtggtgagctggttgctatggaaacggcgggttgaggagggggcagtcctgcgacagggaccccgggccccaaacsagaccccgtcccactttcagatcctcaaagactatgaatac

SEQ ID NO: 566 - DNA, 2020 bp, Homo sapiens
aggcgtgtggggcaggaccagtccttcagcggccgggttcgcgccgcggtcgccggytgmttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccrgccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgmgaaagtttcacagagtccttcaaaagactctgaagaaaaccctgccactgaagaacgtccagaaaaaattttggctgaaacacaacctgaattgggaacgtggggagatggcaaaggcgaagatgagttawccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagaygtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcckcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattattactcctccaaagactgctgcccccagarcaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgg

SEQ ID NO: 567 - DNA, 1356 bp, Homo sapiens
gaaacctctcctcgtctgtgcacgaacaggtggccaactctggagcccaggctgttgctttccagtctggtggtgaatcctccatagtctggaacagccagctgaaaactctcctggccattggaggctggaacttcrggactgcccctttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgytggtcctgckgggccctatgccaaggagtctgggatctgggcttactacgagatctgtaccttcctgaaaaatggagccactcagggatgggatgcccctcaggaagtgccttatgcctatcagggcaatgtrtgggttggctatgacaacrtcaagagcttcgatattaaggctcaatggcttaagcacaacaaatytggaggcgccatggtctgggccattgatctggatgacttcactggcactttctgcaaccagggcaagyttcccctaatctccaccctgaagaaggccctyggcytgcagagtgcaagttgcacggctccagctcagcccattgagccaataactgctgctcccagtggcagcgggaacgggagcgggagtagcagctctggaggcagctcrggaggcagtggattctgtgctgkcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtr

SEQ ID NO: 568 - DNA, 1882 bp, Homo sapiens
gccagacacaaaatgtccacaatagaaaatctgaccacagtatctaaacagttgcttatcagyccttggaactgccaaaaaagctattaaactgrtgttttccatggtgatggtctccaccaccctgttagragccatgacattgttctgtccttgttgggcagagaaggtggtgatgctggtggtgggagggtgtaggttgaaggtcttgggagggtgtttgtagaagagaaggtccgttgatttactgattaactacatacacatctgggtcaaattgttctctatttagaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcaccaactgggcccagtacyggccaggcctggggcgcttcatgcctgacracatcracccctgcctctgtacccacctsatctacgcctttgctgggakgcagaacaacgagatcaccaccatcgaatggaatgatgtgactctctaccaagctttcaatggcctgaaaaataagaacagccagctgaaaactctcctggccattggaggctggaacttcrggactgcccrtttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgytggtcctgckgggccctatgccaaggagtctgggatctgggcttactacgagatctgtaccttcctgaaaaatggagccactcagggatgggatgcccctcaggaagtgccttatgcctatcagggcaatgtrtgggttggctatgacaacrtcaagagcttcgatattaaggctcaatggcttaagcacaacaaatytggaggcgccatggtctgggccattgatctggatgacttcactggcactttctgcaaccagggcaagyttcccctaatctccaccctgaagaaggccctyggcytgcagagtgcaagttgcacggctccagctcagcccattgagccaataactgctgctcccagtggcagcgggaacgggagcgggagtagcagctctggaggcagctcrggaggcagtggattctgtgctgkcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 569 - DNA, 6314 bp, Homo sapiens
gtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaaggtgtccccctgaagcccagaaaagagttacgatttacagaactgcagtctggacagctggaggttaagtggtcctcgaaattcaatatttctattgagcctgtgatctatgtggtacaaagaagatggaattatggaatccatcctagcgaagatgacgccactcactggcagacagtggcccagaccacagacgagcgagttcaactgactgacataagacccagccgatggtaccagtttcgagtggctgctgtgaatgtgcatggaactcgaggcttcactgcccccagcaaacacttccgttcttccaaagatccatctgccccaccagcaccggctaacctccggctggccaactccaccgtcaacagtgatgggagtgtgaccgtcactatagtttgggatctccccgaggagccggacatccctgtgcatcattacaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaaagaacagcttgtgaaaactagaaaaggtggaattcaaacacaactcccttttcaaagacgacgacccactcgcccgctggaagtcggagctcccttctatcaggatggccaactgcaagttaaagtctactggaagaagacagaagatcccactgtcaaccgatatcatgtgcggtggtttcctgaagcgtgtgcccacaacagaacaaccggatcagaggcatcatctggcatgacccacgaaaattacataattcttcaagatctgtcattttcctgcaagtataaggtgactgtccaaccaatacggccaaaaagtcactccaaggcagaagctgttttcttcactactccaccatgctctgctcttaaggggaagagccacaagcctrttggctgcctgggcgaagcaggtcatgttctttctaaggtgctagctaagcctgagaacctttctgcttcattcatcgtccaggatgtgaacatcaccggtcacttttcttggaagatggccaaggccaatctctatcagcccatgactgggtttcaagtgacttgggctgaggtcactacggaaagcagacagaacagcctacccaacagcattatttcacagtcccagattctgccttccgatcattatgtcctaacagtgcccaatctgagaccatctactctttaccgactggaagtgcaagtgctgaccccaggaggggaggggccggccaccatcaagacgttccggacgccggagctcccaccctcttcagcacacagatctcatcttaagcatcgtcatccacatcattacaagccttctccagaaagatactaaactgttcaaaaagattttgtgaaattgcacagatgtgtaagcttgttgaacttcggccacgagacatgcacacttccagaggcagtgggaactgctcagaggcccggactctcctatgtgactttagtgcaggaagaacttctgtcaatcatggacgcatctggagacaagtgagaaacagtagattggtgaagacagacaccagttccctacaagcatggagaaaatgaagaataggcctgtttaatgctaaattttgttttcatgtatggtgtcgctcatttctattgaattacaacagaactcagttttccctgaatttggagcaccaaactccgccccaaaaaggagagtaacaaatacacaattcacacataacactaagcgtaaatctaatcaataaaatatatttttgactaaattattgattcgatatgaaaaatcaactaagattacacagctttgtttttttgaatctttcctaagatcatttttatcctaggtgatttttaaatgaaaatgtgtaatctaaaatataccagcgaatttaaatctaaaaatgctcctactttaagtaccttgtgctgctctttatgcaaaggtaaatcaaagttccctctataaattatgatttacaaaagacacccaagccagaggaactcaatgaaataagctgctaatcagattttaccttggagaaatgaaaattatttcttggggatgccttttaatatttgatcctattatgtgagagattttcctgatatgttatcttatttatattttcccttattttcctcaatgcagataatagcttttggtgcacttttgtttcaccatctgaaaattcacaaaacttcttgcttcaaatgaaaaaatcccaactattgagcatgtttaaatctttgcagagatttgccttttcttaatcaaagaaaggtctttgtgtgctagaatattattggtaatgttttaaaaattcctttgattgatagagaaggacagttatttgcatttaattcacccatatgctttcaaatctagtatatcttactttttggaaatgttttatgctacaaattagtgccttgtagcatgaacttaagtcaaaacgtgttatcaatatagagwgttgcagtgtatattgtaacaacctaaaacgcagagaagtttaatttaatactgttttttttcttgaaggaatactcacatacatggtttgaaatgtgcatagatatgcatgtctatataattataaatgcatgtgtatatatatgcaaatatatgtacatatacatgtatatacacacagacacatgcatatacatgaatataccttgagcatgaatccctggagaaatcgttttcrtagctcaccaatggtgagtaaagatacagctcttttaaaggtcataaggataatatattttccccatcaatgctgattctgagaaaagagcaakttatcaaaattaaacactgtaaaagaaaggtgtccayatgtctttacctacctaagtaaaacaggaagaaaatcagtaacattatccttaggttttgacaatggtacttgcttcttgttgttttattgtttcctgaattcatgcagatgcctggccattcctgggaagagtggataactcagaagtcactgtactccacagagcctcactgcagtgtctaaaggtagatgcaaattaaaatgcagggaaaataacttttctgatgttgatgcatgtctttgggaaacacatttataaacatggatacctgataatagatattgaaacccatttcctgtgtgttaaaatatttaaaaagtggatattccaggaatgttttgcagctttgtacaagtaacataaattggacacctcagaatgaaagttcatgttggttctgaatggttcrctgcagctcctgtcacargctgggatggatttatcacattgagttatgaaattacctggttctaagaatttttgagtggcaaaaatagaaaacaatcttcatttgaaaacatccctaagcttgaataaatggataccatagatagyttctcttttttattctggtgtcattaccagcatctgaatttcaagttcttaaaatttcaaaaattaaaatttttcattattagctatccatttatcttttacaygaacttgtcatgaacaaattcaaatgtttatgccagcaaatttttgtactgttgcatagttaaaaatgctgggagtctctgcatagatacaaaatattattaaattattacataaatttaattttataaaatttaatcatgcttcttttgtctgggtaatagacattggacagatatttttagttcagatggtgattctgaagcttacatctcccttaaaaaaatctaaagcagctcttatgggcttctaattttaatataaataaataatttaaattttattggtgttattggaagaaaaatgctattaatgggctaataaaaaacatgtgtttctcttatggattttaataagctccagtattattcaaatgatcaaaaatatagttataattttttgaattttaaaaatgtgattgctctaataaagaataaaatctatgctttttaacaaacatagttttggtgcctaattctgtaatatgttttattgaaattagattcatttctctaatgtgagaaaaatatatccagtaatagtattgactgtttaaaaaattgagctcatcaaaaatattgtcatcaaatacaggtggttaatctgacatacattgcagttacatgcattatttttatttacaacatttgctccttaatgatgaatttatctgtgttaccctgtttttctacctggaactccatagaatgatgtttgcaaaccaacatgtgctcttttcagtcattcactgttttaatatgacatggtagagaagataaggtttatggcaggtaattttttgtaatgtgtattaaacgaagttcaaagattagaaatacatctgtgtcctgaaaaccttagatacatagccgaytgtatacagaggttcatctcaamctcaacactattgacttttggggctggatagttctctgttgtgggggtttgtcttgtgcactgtaggtttttagtagcatccacactttctcctcaccagatgccagttgcaccctcccccaagttgagacaaccaaaaatgtctccagatattgccagctaccccttgagggatggtacctctggttgagaaccattgctagagaatgatctttactgaatttgccctttataagaaacccagtgaatttctagagcaagtcccaaaaactaagggacagctaagaagttattatggttgacttcaaaggcctaaactgtgttttttatgtccactaaacaacttgattaaaagacggaattttgactcgtgtctgtatcatacaagtacaaatactaattttgccctatgtatccgtaaatgtcatttgtgattttgacttatttatttaatgccctttcttatgccgtgggttttcaagtttactcatttctatggttgcaaataactctaaaacttattatataaactttcatattataggcagaacacaatggctaaatatctgttgcatgtactttaaagtttattataaaatataaacagatatataaagatgttgactcttacctgtgattttgcatggtcagactcggtgtcaggtacggagaggattctcatgactgtcttacctctactgaatattctagtgagttatatgatttacggagtgattaacagaggtctatataaagttacttttcccctttacttaattatattgtagtgtgcagataacaaaactgctaccttctcatccaagtggtctgtagaattcatgtcccttacagtggtcatttaaagtcaatatttatttatgtatgtaataaaaaaagttggatttttgtgtatgtctgtcacattatttagagagaagtaatcttgtaaaaatgttttgtaaaaaacaaaaaagtattgtaaatagtcttgatattctgtgactcattattttcatgttagagtttgtacatactggttcaataataaagtatccttaaaccaga

SEQ ID NO: 570 - DNA, 1449 bp, Homo sapiens
gtcggcgaggagggtccggccggagttgaaggattgaactttccggctcagtcgcggcgkctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttcyagcacttccagaacaatggttccctggtttggtgccagaatcacaagcaatgttctaagtgcctggagccctgcaaggaatcaggggacctgaggaaacaccagtgccaaagcttttgtgagcctctcttccccaagaagagctacgaatgcttgaccagctgtgagttcctcaaatacatcctgttggtgaagcagggggactgtccggctcctgagaaagccagtggatttgcggccgcctgtgttgaaagctgcgaagttgacaatgagtgctctggggtgaagaaatgttgttcgaatgggtgtggacacacctgtcaagtacccaagactctgtacaaagatccatctgccccaccagcaccggctaacctccggctggccaactccaccgtcaacagtgatgggagtgtgaccgtcactatagtttgggatctccccgaggagccggacatccctgtgcatcattasaaggtcttttggagctggatggtcagcagtaagtctcttgtcccaacaaagaagaagcggagaaagactacggatgggtttcaaaattctgtgatcctggagaaactccagccagactgtgactatgttgtggaattgcaagccataacgtactggggacagacacggctgaagagtgcaaaggtgtcccttcacttcacatcgacacatgcaaccaacaacaacagaactacaggaaacagtggaagcagaaatgaccaacatggagttggggaatgagagtcacatcatccctcatgaagtcctgaagagtgagcgatctgcaggcccacaaggaatggacatcattccacacaaacgcagcagcgtggatgagtgtagagagttagagaagcgcattgcatgggcagagaactcagcgtgaggaaagaatgaaggtggatgggccactggtctctcccctggaggtctcattgagttgcaaggatttaaccaccatctgtgtgctaatgactccctgccctcccaccctgaccactctttgaactccagagtcctgcattcagccacccacttagcacctccccttggatggcttgcagatatttcaaataaaacgttcaaacacaa

SEQ ID NO: 571 - DNA, 1573 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgacgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 572 - DNA, 1388 bp, Homo sapiens
ggctctttccaacgctgtaaaaaaggacagaggctgttccctatggcagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 573 - DNA, 1625 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 574 - DNA, 1567 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 575 - DNA, 1339 bp, Homo sapiens
aagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 576 - DNA, 1508 bp, Homo sapiens
tcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 577 - DNA, 1450 bp, Homo sapiens
tcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcagaaggcaaccacagaaaaaagccacttaaggtgttggaatccctgggcaaagatttcctcactggtgttttggataacttrrtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgakaacctrgaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 578 - DNA, 3659 bp, Homo sapiens
  misc_feature (1)...(3659): n = A,T,C or G, or insertion/deletion polymorphism (see Tables 1-2)
cggcggcgcaggtgaggcgcggggccggggccggaccgggaggcggggaccccccgcccccccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctagaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcgcattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccntcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacytggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgtttaaaaaatctcagaac

SEQ ID NO: 579 - DNA, 3090 bp, Homo sapiens
  misc_feature (1)...(3090): n = A,T,C or G, or insertion/deletion polymorphism (see Tables 1-2)
gtgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccntcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacytggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgtttaaaaaatctcagaac

SEQ ID NO: 580 - DNA, 3644 bp, Homo sapiens
  misc_feature (1)...(3644): n = A,T,C or G, or insertion/deletion polymorphism (see Tables 1-2)
cggcggcgcaggtgaggcgcggggccggggccggaccgggaggcggggaccccccgccccaccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctaaaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgccgattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggaccccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttggtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcytgaagagcgaaaagaacaagcctctggacccagagatgcagtgcctgctgctctcagatgggaagggctccatccacccgaaccaggtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccntcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcytcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacytggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgttycggactgacctaaaaactaattgtcgagaagccaagggtgaggaggcaggaagcacctccggttggaggcacccaggcttgccagccacagagcgccccraagtcaccgtcatcccagcccctggccttcctgcygccctccggggccatggcrctgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgttt

SEQ ID NO: 581 - DNA, 808 bp, Homo sapiens
ctgsgcctggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaastctggcagctattttgctttaaccgatgacagtaagcgtctgattcttttccgtacaaaaccatggcaatgtctgagtgtcaggacygtggcaaggaggtgtacagccctgactttcatagcctcggaggagaaggtcttggtggccgacaagtctggagacgtctactccttttcggtgctggagccacacgggtgtggccgtctagagctgggrcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccag

SEQ ID NO: 582 - DNA, 2238 bp, Homo sapiens
  misc_feature (1)...(2238): n = A,T,C or G, or insertion/deletion polymorphism (see Tables 1-2)
ctgsgcctggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaastctggcagctattttgctttaaccgatgacagtaagcgtctgattcttttccgtacaaaaccatggcaatgtctgagtgtcaggacygtggcaaggaggtgtacagccctgactttcatagcctcggaggagaaggtcttggtggccgacaagtctggagacgtctactccttttcggtgctggagccacacgggtgtggccgtctagagctgggrcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactnctgtggtctacatcttccagctggacgcccgcagacagcagttggtgtacaggcagcagctggcgttccagcaccaagtgtgggacgtggctttygaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggcyacgttcgacaacgtgacctcctacctgaagaagaaagaggagagactgcagcagcagctagagaagaagcagcggcgccngagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtcsgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgantgcttgagcctgccccagccccagccrtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacckaatataccaggcaaaactccttggtgcctgcgctgtgtgtgtgtgaggtgcgcggtgtgattgtgcgctgtgtgtgtgtgaggtgcacgctgcgtgatcgtgtgctgtgtgag

SEQ ID NO: 583 - DNA, 2080 bp, Homo sapiens
  misc_feature (1)...(2080): n = A,T,C or G, or insertion/deletion polymorphism (see Tables 1-2)
ctgsgcctggcgtcaccgaccggtgcggacaggaagaggctctgggctggcacatgtgtatggcgtgatgatgacagcctcttcatctatgactgcagtgctgcagaaaagaagtcacaagaaaataaaggggaggacgcgcccttggaccaggggagcggtgcgattctggcgtccaccttctccaastctggcagctattttgctttaaccgatgacagacygtggcaaggaggtgtacagccctgactttcatagcctcggaggagaaggtcttggtggccgacaagtctggagacgtctactccttttcggtgctggagccacacgggtgtggccgtctagagctgggrcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactnctgtggtctacatcttccagctggacgcccgcagacagcagttggtgtacaggcagcagctggcgttccagcaccaagtgtgggacgtggctttygaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggcyacgttcgacaacgtgacctcctacctgaagaagaaagaggagagactgcagcagcagctagagaagaagcagcggcgccngagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtcsgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgantgcttgagcctgccccagccccagccrtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaacckaatataccaggcaaaactccttggtgcctgcgctgtgtgtgtgtgaggtgcgcggtgtgattgtgcgctgtgtgtgtgtgaggtgcacgctgcgtgatcgtgtgctgtgtgag

SEQ ID NO: 584 - DNA, 1517 bp, Homo sapiens
  misc_feature (1)...(1517): n = A,T,C or G, or insertion/deletion polymorphism (see Tables 1-2)
ctgsgcctggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaastctggcagctattttgctttaaccgatgacagtaagcgtctgattcttttccgtacaaaaccatggcaatgtctgagtgtcaggacygtggcaaggaggtgtacagccctgactttcatagcctcggaggagaaggtcttggtggccgacaagtctggagacgtctactccttttcggtgctggagccacacgggtgtggccgtctagagctgggrcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactnctgtggtctacatcttccagctggacgcccgcagacagcagttggtgtacaggcagcagctggcgttccagcaccaagtgtgggacgtggctttygaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggcyacgttcgacaacgtgacctcctacctgaagaagaaagaggagagactgcagcagcagctagagaagaagcagcggcgccngagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaa

SEQ ID NO: 585 - DNA, 2568 bp, Homo sapiens
acgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaaraaaatcggggacacccctwtggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcggtggcagtgctggcagcacrgtggcggtggccgtgaaggcygcgcaggagctgcaggagggccagcrctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagmgctgggcggtgcggagcgggcccgccacccttgcccacttctccttcgctttcctgagccctaaacacacrcgtgattggtaactgcctggcctggcaccgttatccctgcasacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcacgttcyggaacattctgtcatcacccygtgaagcaatcatttcccctcccgtcttcctcctcccctggcaactgctgatcgactttgtgtctctgttgtctaaaataggttttccctgttctggacatttcatataaatggaatcacacaatt

SEQ ID NO: 586 - DNA, 2600 bp, Homo sapiens
ctggagacagtctcgctcagtcgcacaggctggaggacagtggcgcgatcccggcctccaatgccaccttccagagccttcatgatgtaactccatccctgtcccctccccacatcgccggctttattgttcttcgtgtcagttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaaraaaatcggggacacccctwtggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcggtggcagtgctggcagcacrgtggcggtggccgtgaaggcygcgcaggagctgcaggagggccagcrctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaccacagcaccgggaagtccagtcagcggcagatggtgttcggggtggtcaccgccattgacttgctgaacttcgtggccgcccaggagcgggaccagaagtgaagtccggagmgctgggcggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcacgttcyggaacattctgtcatcacccygtgaagcaatcatttcccctcccgtcttcctcctcccctggcaactgctgatcgactttgtgtctctgttgtctaaaataggttttccctgttctggacatttcatataaatggaatcacaca

SEQ ID NO: 587 - DNA, 2666 bp, Homo sapiens
aaggccctgggatcagaaaactcgctggttaatragtggccaagaacatatcagcttaagtttgggaaaaacacacaacagggcattgtgtcagagggtgaccaaagtgactccccagcagatggacmagggaacgaacaggtgacctttgaactgaggccggagtggaagcagcgagggtgtgaagggccgggtgagggtcaaaggcagaagcaagcaggtggggagggttagcgtcatgcctgctaaggagcagtggacgggtcctagcacgtgctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagarcgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggycaatggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcggtggcagtgctggcagcacrgtggcggtggccgtgaaggcygcgcaggagctgcaggagggccagcrctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagmgctgggcggtgcggagcgggcccgccacccttgcccacttctccttcgctttcctgagccctaaacacacrcgtgattggtaactgcctggcctggcaccgttatccctgcasacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcacgttcyggaacattctgtcatcacccygtgaagcaatcatttcccctcccgtcttcctcctcccctggcaactgctgatcgactttgtgtctctgttgtctaaaataggttttccctgttctggacatttcatataaatggaatcacacaatt

SEQ ID NO: 588 - DNA, 1302 bp, Homo sapiens
ctggagacagtctcgctcagtcgcacaggctggaggacagtggcgcgatcccggcctccaatgccaccttccagagccttcatgatgtaactccatccctgtcccctccccacatcgccggctttattgttcttcgtgtcagttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaaraaaatcggggacacccctwtggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcatcaytggggtggatcccgaagggtccatcctcgcagagccggaggagc

SEQ ID NO: 589 - DNA, 3105 bp, Homo sapiens
  misc_feature (1)...(3105): n = A,T,C or G, or insertion/deletion polymorphism (see Tables 1-2)
tcgccgcagtcggggcagccgctcgcccctcttttccatgtatccgtccagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaaraaaatcggggacacccctwtggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcggtggcagtgctggcagcacrgtggcggtggccgtgaaggcygcgcaggagctgcaggagggccagcrctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagggtccccaaatcaagtcttcctggagcytgtccacgcttgtcaccaccgtctgtggctgctttcaagcacgtcagggctgcgtgctcataacagagacggcacngcccccaagacctaaaataccaccagctggcccttgtcggaaagtcccctggctggccctagtccattgactctgggccgngctgccaggnccacagaagcctgcggcactcagggctcccagggctcccttctccaacagttgctgtgcctccgtttccccnaaatgcaaggagctgatctcatctgtgttccctntcttttcctggggctctaagtgggccaccccaagggacctctgcctacaaagagaggagtgacagccgtggcggagttgggacgggctccgagggctcttcctcacccgcaccttgctcacccctctgtgcctcatgacagctggtgtagggtcctgtggagacgcaggaccaagaggatgtgtggggagcggggagagagagggaacgagatctgtgttaaggaactggatcatgagatcacggaggctgacaaaccctgagatctgcagggtgaggcggcaggccggagactggagagccagcagttcaagccccaaggcaggaaattccacctttggttctattcaggccttcaactgcttgggtgaggccctccacagtagcacacgttatctgcctcttgactcttgtgctaatccggaatcccctcacacatgcccagaacgacgtgtgaccaatgcctgggctcccacggccccgttaatctgtattaaaattaaccatcacaacagccctgtctgggtatgtggcatgggagcctcggccagcattaacaccgggtctacgcttgccaggagaaagcaggaggggtgaagacagaatcaggccagagatggaagctgtgtgctgcccatggtggcaaggggtttttgtctgtttttagagacagggtcttgctctgttgccgactggagtgcagtagtgccatcatagctcgctgcagcctcgacctgctgtgctcaactgatccttctgcctcagtctcccaagtagctgggaccacaagcgtgtgccaccatgctcgactaatttatttttaaaaatattctrtagagacagggtcwcaatatgttgcccaggctggtcccagacttccgggcttaaatgatcctcccaccttggcctcccacagcgctgggatcacaggtgtgagccactgtgcccggccctgtaagcgggtttgaatttcatgcccacaccggctctgaagtcatgagtgcctcaggagctcagccggtgggccagggaagggtgtgtcctgacctgcggtgggtggagcctggcctggggcccaggggactcacgtggtgggtagaacctggcctggggg

SEQ ID NO: 590 - DNA, 3376 bp, Homo sapiens
ggatcccccatttagccatagggcggggggatcaggttcagcctctgaaagtccagagcacgatgtttgggaaacggccccgcccgcggcctccgggacctggcgaaggagccccgcggggcgcccctgctaccaccctgcgcggagtcggccccgtccccgagagcgcccggcagcccctggccgtgggccgcaccggagccgcgcaaggcgactgttctgcgcctcggmtcggggttcggacccggctctgggcgcggtcacgcggggcgctgcgcacggcgtccggcggccacagagcgcggccatcgagtcccgccccggcgcggcgccccctcccgggcccgcgacacacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggtagaagacaccaccggggtccgcgggtgggggtggctggaacccggggcgggcgggctcaggcgaagaggaaggcgggggagggggcggcgacccgggtctgcggttgaatcaacagggcgtgggaatggggcgggcggactggggtgggggcatgccggggtcccggggagggcgggggtcgggcaggccggagggtcccaggctgcggcggggtggggaaggggtgggggggaggggcccgggctgggtggggtggaggaggggctgggggggcgggtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaaraaaatcggggacacccctwtggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcggtggcagtgctggcagcacrgtggcggtggccgtgaaggcygcgcaggagctgcaggagggccagcrctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagmgctgggcggtgcggagcgggcccgccacccttgcccacttctccttcgctttcctgagccctaaacacacrcgtgattggtaactgcctggcctggcaccgttatccctgcasacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcacgttcyggaacattctgtcatcacccygtgaagcaatcatttcccctcccgtcttcctcctcccctggcaactgctgatcgactttgtgtctctgttgtctaaaataggttttccctgttctggacatttcatataaatggaatcacacaatt

SEQ ID NO: 591 - DNA, 2558 bp, Homo sapiens
ctggagacagtctcgctcagtcgcacaggctggaggacagtggcgcgatcccggcctccaatgccaccttccagagccttcatgatgtaactccatccctgtcccctccccacatcgccggctttattgttcttcgtgtcagttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaaraaaatcggggacacccctwtggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcggtggcagtgctggcagcacrgtggcggtggccgtgaaggcygcgcaggagctgcaggagggccagcrctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagmgctgggcggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcacgttcyggaacattctgtcatcacccygtgaagcaatcatttcccctcccgtcttcctcctcccctggcaactgctgatcgactttgtgtctctgttgtctaaaataggttttccctgttctggacatttcatataaatggaatcacaca

SEQ ID NO: 592 - DNA, 5054 bp, Homo sapiens
  misc_feature (1)...(5054): n = A,T,C or G, or insertion/deletion polymorphism (see Tables 1-2)
ttgggacgatcatagagcgctagcactgaatcagcctggagagcgcggaaggaaagggtcggtccgcagagggcgcggggaaggcagggtggggacgcggtggagcccgcgctcgtttgctgaaggcttggaagtgcagcgcagaagacagagggtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcrgctgattgacagtcagatggagacctcgtgccaaattacatttgagtttgtagaccaggaacagttgaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggargatattcttgactctgcaatgggcactaattgggtcccagaagaagcctctggagaggccagtgagattcccgtaccccaagggacagagctttccccctccaggccaggagggggcagcatgcagacagagcccgccagacccarcaacttcctctcagcatcttctccactccctgcatcagcaaagggccaacagccggcagatgtaactggtacmgccttgcccagggtgggccccgtgaggcccactggccaggactggaatcacaccccccagaagacagaccatccatctgccctgctcagagaccccccggagccaggctctcccaggatctcatcacygcgcccccagggcctcagcaacccctccaccctctctgctcagccacagctttccagaagccactcctcgggcagcgtgctgccccttrgggagctggagggcaggaggagcaccagggatcggaggagccccgcagagccagaaggaggaccagcargtgaaggggcagccaggcccctgccccgttttaactccgttcctttgactgacacaggccatgagaggcagtccgagggatcctrcagcccgcagctccaggagtctgtcttccacctgctggtgcccagtgtcatcctggtcttgctggcygtcggaggcctcttgttctacaggtggaggcggmggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgctcttttcagtcatgcccctcctgctcttttgtatttggctaatagtatatcaatttgcacttatctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcycagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagkgtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgancaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccackttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccatgtga

SEQ ID NO: 593 - DNA, 3931 bp, Homo sapiens
  misc_feature (1)...(3931): n = A,T,C or G, or insertion/deletion polymorphism (see Tables 1-2)
cctgggtcctctcggcgccagagccgctctccgcatcccaggacagcggtgcggccctcggccggggcgcccactccgcagcagccagcgagcgactgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcrgctgattgacagtcagatggagacctcgtgccaaattacatttgagtttgtagaccaggaacagttgaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggargatattcttgactctgcaatgggcactaattgggtcccagaagaagcctctggagaggccagtgagattcccgtaccccaagggacagagctttccccctccaggccaggagggggcagcatgcagacagagcccgccagacccarcaacttcctctcagcatcttctccactccctgcatcagcaaagggccaacagccggcagatgtaactggtacmgccttgcccagggtgggccccgtgaggcccactggccaggactggaatcacaccccccagaagacagaccatccatctgccctgctcagagaccccccggagccaggctctcccaggatctcatcacygcgcccccagggcctcagcaacccctccaccctctctgctcagccacagctttccagaagccactcctcgggcagcgtgctgccccttrgggagctggagggcaggaggagcaccagggatcggaggagccccgcagagccagaaggaggaccagcargtgaaggggcagccaggcccctgccccgttttaactccgttcctttgactgacacaggccatgagaggcagtccgagggatcctrcagcccgcagctccaggagtctgtcttccacctgctggtgcccagtgtcatcctggtcttgctggcygtcggaggcctcttgttctacaggtggaggcggmggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcycagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagkgtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgancaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccackttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccatgtgagt

SEQ ID NO: 594 - DNA, 4706 bp, Homo sapiens
  misc_feature (1)...(4706): n = A,T,C or G, or insertion/deletion polymorphism (see Tables 1-2)
ttgggacgatcatagagcgctagcactgaatcagcctggagagcgcggaaggaaagggtcggtccgcagagggcgcggggaaggcagggtggggacgcggtggagcccgcgctcgtttgctgaaggcttggaagtgcagcgcagaagacagagggtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcrgctgattgacagtcagatggagacctcgtgccaaattacatttgagtttgtagaccaggaacagttgaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggargatattcttgactctgcaatgggcactaattgggtcccagaagaagcctctggagaggccagtgagattcccgtaccccaagggacagagctttccccctccaggccaggagggggcagcatgcagacagagcccgccagacccarcaacttcctctcagcatcttctccactccctgcatcagcaaagggccaacagccggcagatgtaactggccatgagaggcagtccgagggatcctrcagcccgcagctccaggagtctgtcttccacctgctggtgcccagtgtcatcctggtcttgctggcygtcggaggcctcttgttctacaggtggaggcggmggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgctcttttcagtcatgcccctcctgctcttttgtatttggctaatagtatatcaatttgcacttatctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcycagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagkgtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgancaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccackttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccatgtga

SEQ ID NO: 595 - DNA, 4160 bp, Homo sapiens
  misc_feature (1)...(4160): n = A,T,C or G, or insertion/deletion polymorphism (see Tables 1-2)
ttgggacgatcatagagcgctagcactgaatcagcctggagagcgcggaaggaaagggtcggtccgcagagggcgcggggaaggcagggtggggacgcggtggagcccgcgctcgtttgctgaaggcttggaagtgcagcgcagaagacagagggtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcrgctgattgacagtcagatggagacctcgtgccaaattacatttgagtttgtagaccaggaacagttgaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatcctrcagcccgcagctccaggagtctgtcttccacctgctggtgcccagtgtcatcctggtcttgctggcygtcggaggcctcttgttctacaggtggaggcggmggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgctcttttcagtcatgcccctcctgctcttttgtatttggctaatagtatatcaatttgcacttatctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcycagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagkgtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgancaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccackttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccatgtga

SEQ ID NO: 596 - DNA, 4807 bp, Homo sapiens
  misc_feature (1)...(4807): n = A,T,C or G, or insertion/deletion polymorphism (see Tables 1-2)
tcctttctcgggaagcttgggtctccctgggagcgggtctgcccttagggggaggcctctgggctctgtgccctgcagctcggcagycattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgyaccccactcccaagtagcytgaaaaagggaggacagtctttccccagcaggggtcaggggggcccctcaggaagcctaaggtcgtgctagtgtggtgacccccatacattcctccctgctccccactgccaggagraccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacaccyccattggtgtggccaagctgcccccattcctatccacccctctccccaccccgtcctgtccatgcgcttccagggccccacggtccccaggaggacgcttcctggccaaagccccaagcctttggtgagaagccayttcccacttgacagaaggcgtccatccattcatctcantggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcracagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagyatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggmtcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcsagacaccatcccaggtgtgtgtaagagagagagagagaacagggaggatacagaagtattgcagcccagatcccctatcagggggacagctggtgggcaaagcagccaccccacagccttgtggctagagtacagtggggtrgaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccscgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 597 - DNA, 4747 bp, Homo sapiens
  misc_feature (1)...(4747): n = A,T,C or G, or insertion/deletion polymorphism (see Tables 1-2)
tcctttctcgggaagcttgggtctccctgggagcgggtctgcccttagggggaggcctctgggctctgtgccctgcagctcggcagycattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgyaccccactcccaagtagcytgaaaaagggaggacagtctttccccagcaggggtcaggggggcccctcaggaagcctaaggtcgtgctagtgtggtgacccccatacattcctccctgctccccactgccaggagraccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacaccyccattggtgtggccaagctgcccccattcctatccacccctctccccaccccgtcctgtccatgcgcttccagggccccacggtccccaggaggacgcttcctggccaaagccccaagcctttggtgagaagccayttcccacttgacagaaggcgtccatccattcatctcantggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcracagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagyatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagtgagcgtgtgtgctctcagggaagggcccaggmtcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcsagacaccatcccaggtgtgtgtaagagagagagagagaacagggaggatacagaagtattgcagcccagatcccctatcagggggacagctggtgggcaaagcagccaccccacagccttgtggctagagtacagtggggtrgaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccscgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 598 - DNA, 1978 bp, Homo sapiens
cccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagcctcccaaagtgctgggattacaggcgtgagccactgcacctggccctgttgcaatcctgtattttttagtagagacagggtttcaccatgttggccaggctggtctcgaactcctgacctcaggtgatctgcccgcctct

SEQ ID NO: 599 - DNA, 6833 bp, Homo sapiens
  misc_feature (1)...(6833): n = A,T,C or G, or insertion/deletion polymorphism (see Tables 1-2)
cccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggaggcrgtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcntacagaccgaggcacagagcctggccccattcggccatcccatcgacctggtcccccagtccagtttggcactagtgrcaaggactcagacttacgcctartggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcayggactcccccaactggaaggtcctyctctggcctcaattcccgtctsaaggccacgccttccacctacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 600 - DNA, 6700 bp, Homo sapiens
  misc_feature (1)...(6700): n = A,T,C or G, or insertion/deletion polymorphism (see Tables 1-2)
atgtccgatcgctcggggccgactgccaagggaaaggatggaaagaagtattcctcgctcaacctgtttgatacgtataagggcaagtccttagagatccagaaacccgctggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggaggcrgtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcntacagaccgaggcacagagcctggccccattcggccatcccatcgacctggtcccccagtccagtttggcactagtgrcaaggactcagacttacgcctartggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcayggactcccccaactggaagacgcccttcttcccttaggtcctyctctggcctcaattcccgtctsaaggccacgccttccacctacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattt

SEQ ID NO: 601 - DNA, 6683 bp, Homo sapiens
  misc_feature (1)...(6683): n = A,T,C or G, or insertion/deletion polymorphism (see Tables 1-2)
atgtccgatcgctcggggccgactgccaagggaaaggatggaaagaagtattcctcgctcaacctgtttgatacgtataagggcaagtccttagagatccagaaacccgctggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggaggcrgtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcntacagaccgaggcacagagcctggccccattcggccatcccatcgacctggtcccccagtccagtttggcactagtgrcaaggactcagacttacgcctartggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcayggactcccccaactggaaggtcctyctctggcctcaattcccgtctsaaggccacgccttccacctacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 602 - DNA, 6871 bp, Homo sapiens
  misc_feature (1)...(6871): n = A,T,C or G, or insertion/deletion polymorphism (see Tables 1-2)
cccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggaggcrgtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcntacagaccgaggcacagagcctggccccattcggccatcccatcgacctggtcccccagtccagtttggcactagtgrcaaggactcagacttacgcctartggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcayggactcccccaactggaaggtcctyctctggcctcaattcccgtctsaaggccacgccttccacctacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 603 - DNA, 11409 bp, Homo sapiens
gctcaagaccatcagcctggtgatccgcggcacgcagggggccgaggaggtgctcagggcccacgaggagcagctcaaggaggcccaggccgtgccggccaccctcccggagctcgargccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgccyaggcaaaggcacaggcggagcgggaggcgaaggagctgcagcagcgcatkcaggaggaggtggtgcggcgggaggaggcggcggtggacgcscagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgayaggcrcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcrgagcggygcctgcgscaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgygaggaggcagagcggsagctggagcgctggcagctcaaggccaacgaggcgctacggctgcggctgcaggcggaggaggtgsygcagcagaagagcctggcgcaggccgaggctgagaagcagaaggaggaggcggagcgcgaggcgcggcggcrcggcaaggcggaggagcaggccgtccggyagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcrarggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagyaggccgcgcaacacaaggctgacatcgaggagcgcctggcccagctgcgcaaggcatcggacagcgagctggagcggyagaaggggctggtggaggacacgctgaggcagcggcggcaggtggaggargagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcgkaggaggagcggcggcgccgtgaggctgaggagcgcgtgcagaagagcctggcggccgaggaggaggccgcacggcagcggaaggcggcgctggaggaagtcgagyggctkaaagccaasgtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccrgctgcgcggcgaggcggaggcggcccggcgggcggctgaggaggcggaggaggcccgggtgcaggcggagcgtgaggcggcgcagkcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgygactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagcygagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccragggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagytctactcagagctgcaggcccgtgagacctttgaaaagaccccggttgaggtccccgtgggtggcttcaarggcaggacggtgacggtgtgggarctcatcagctcwgagtacttcactgcggagcagcggcaggagctgttgcgtcagttccgcacgggcaaggtcaccgtggagaaggtcatcaagattctcattaccatcgtggaggaggtggagaccctkcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggytgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggstgaggacctgttcgaggctcggatcatctctctcgagacytacaayctkctccgggagggcaccargagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcagrgmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtrgtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccwagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctytctcccatggagccccagccccctttgggcccagggacaccagccaggctctgtgctgaccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 604 - DNA, 3806 bp, Homo sapiens
tgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacayrgtgcacctgcctctggatttccaccagctggccttctacgtgytggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagacyctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcrctttctggactatctcaccyggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctccttctccaagagtcctgagtggcagatgtgycactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcargagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaarccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctytgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgarggtatatgagggcaagaatcagggttatttaacagattccgtaggtcatttggatgagtatcagctttgaggaccacaggcctggggaatgggcaattttmttttattttgtttttagagttgggggtctcactctgttgcccaggctgcagtacagtggcatgatcataggtcartgcaccctcaaacttctggacttcagtgatcctcccacgttagcctccagagcagctgcgactacaggtgcaagccatcacgcctggctaatttttaaatt

SEQ ID NO: 605 - DNA, 3725 bp, Homo sapiens
tgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacayrgtgcacctgcctctggatttccaccagctggccttctacgtgytggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagacyctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcrctttctggactatctcaccyggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctccttctccaagagtcctgagtggcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcargagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaarccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctytgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgarggtatatgagggcaagaatcagggttatttaacagattccgtaggtcatttggatgagtatcagctttgaggaccacaggcctggggaatgggcaattttmttttattttgtttttagagttgggggtctcactctgttgcccaggctgcagtacagtggcatgatcataggtcartgcaccctcaaacttctggacttcagtgatcctcccacgttagcctccagagcagctgcgactacaggtgcaagccatcacgcctggctaatttttaaatt

SEQ ID NO: 606 - DNA, 3809 bp, Homo sapiens
tgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacayrgtgcacctgcctctggatttccaccagctggccttctacgtgytggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagacyctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcrctttctggactatctcaccyggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctccttctccaagagtcctgagtggcagatgtgycactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcargagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaarccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctytgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgarggtatatgagggcaagaatcagggttatttaacagattccgtaggtcatttggatgagtatcagctttgaggaccacaggcctggggaatgggcaattttmttttattttgtttttagagttgggggtctcactctgttgcccaggctgcagtacagtggcatgatcataggtcartgcaccctcaaacttctggacttcagtgatcctcccacgttagcctccagagcagctgcgactacaggtgcaagccatcacgcctggctaatttttaaatt

SEQ ID NO: 607 - DNA, 3890 bp, Homo sapiens
gtagagggcgcgcgagggggcccggggtcaggtgggggaccccattggaggcgggattgtggggaggtccctgggccgcccctcccgccccctgcccgcccagcctgcttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacayrgtgcacctgcctctggatttccaccagctggccttctacgtgytggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagacyctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcrctttctggactatctcaccyggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctccttctccaagagtcctgagtggcagatgtgycactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcargagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaarccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctytgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgarggtatatgagggcaagaatcagggttatttaacagattccgtaggtcatttggatgagtatcagctttgaggaccacaggcctggggaatgggcaattttmttttattttgtttttagagttgggggtctcactctgttgcccaggctgcagtacagtggcatgatcataggtcartgcaccctcaaacttctggacttcagtgatcctcccacgttagcctccagagcagctgcgactacaggtgcaagccatcacgcctggctaatttttaaatt

SEQ ID NO: 608 - DNA, 2598 bp, Homo sapiens
tgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacayrgtgcacctgcctctggatttccaccagctggccttctacgtgytggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagacyctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcrctttctggactatctcaccyggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctccttctccaagagtcctgagtggcagatgtgycactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcaggtgagggggcagggcggactgcaggctccgccctccccacccgtcaatcagcgggtgtcccacttccgcctgggctggctgtgcaaccttgggcaagttactcaacctctctatgcctcagtctcctcaactgtgaaatgaggttgataacagtgcctatctcgtggagttgtgataat

SEQ ID NO: 609 - DNA, 885 bp, Homo sapiens
  misc_feature (1)...(885): n = A,T,C or G, or insertion/deletion polymorphism (see Tables 1-2)
tggtcacggccccgcggggcagccatgcctggccgtctgctgcggggcctgtggcagcgatggcgccgttacaagtaccgcttcgttccctggatcgcactgaacctaagccacaacccgaggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttanaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttat

SEQ ID NO: 610 - DNA, 1602 bp, Homo sapiens
  misc_feature (1)...(1602): n = A,T,C or G, or insertion/deletion polymorphism (see Tables 1-2)
agagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagggcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgwctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttanaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttat

SEQ ID NO: 611 - DNA, 1123 bp, Homo sapiens
  misc_feature (1)...(1123): n = A,T,C or G, or insertion/deletion polymorphism (see Tables 1-2)
agagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagggcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgwctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttanaaatgagtgatagtacatggctaacgtcagaaattcataaccctctggctgtgggacagtatgtcaacaattgttccaatggtaagaaggcatcatggggctgtgagatgagatatatcaatggc

SEQ ID NO: 612 - DNA, 1806 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcaggtagggag

SEQ ID NO: 613 - DNA, 1665 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcaggtagggaggtg

SEQ ID NO: 614 - DNA, 1395 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctg

SEQ ID NO: 615 - DNA, 3662 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggackagaaccttgctgacccccaagcagaagacagacctctggttttctttgacctcaagattgacaatgaaacccagaagattagccagctggctgcggtgaaccgggaaagcaagttccgcgtggtcatccagcctgaagccttcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctgga

SEQ ID NO: 616 - DNA, 3062 bp, Homo sapiens
cctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtgcatggagcccatggagaccgccgagccacacccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttytgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatc

SEQ ID NO: 617 - DNA, 3088 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttytgagtccctggccaatagcacagccttccatgccccgacccccaccccaagcctytccactaggcctytgccaggatctaagcccatgagcacagggactggctatcccaagacctggcagatgtggctgctcaataaacacttgttgaaccatcaaaaaaaaaaaaaaa

SEQ ID NO: 618 - DNA, 1797 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggtgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatcaaaaaaaaaaaaaaa

SEQ ID NO: 619 - DNA, 2093 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttaaaaaaaaaaaaaaaaaaaaaaaaaaaaaaaaaaaaa

SEQ ID NO: 620 - DNA, 3768 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcggtgagtggcccagaagttcaggccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttytgagtccctggccaatagcacagccttccatgccccgacccccaccccaagcctytccactaggcctytgccaggatctaagcccatgagcacagggactggctatcccaagacctggcagatgtggctgctcaataaacacttgttgaaccatcaaaaaaaaaaaaaaaaaaaaaaaaaaaaaaaaaaaaaaaaaaaaaaaaaaaaaa

SEQ ID NO: 621 - DNA, 2952 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatcaaaaaaaaaaaaaaaaaaaaaaa

SEQ ID NO: 622 - DNA, 3073 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtgcatggagcccatggagaccgccgagccacagtcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatcaaaaaaaaaaaaaaa

SEQ ID NO: 623 - DNA, 2199 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtcgcctt

SEQ ID NO: 624 - DNA, 3714 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatcaaaaaaaaaaaaaaa

SEQ ID NO: 625 - DNA, 1810 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttaaaaaaaaaaaaa

SEQ ID NO: 626 - DNA, 4601 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggackagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgttcctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagatcgacagccccttcctcctcctccctccttcccatccctactcattagctccctcgtcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaacaggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaaaaaaaaaaaaaaaaaaaaaaaaaaaaaaaaaaaaaaaaaaaaaaaaaa

SEQ ID NO: 627 - DNA, 492 bp, Homo sapiens
  misc_feature (1)...(492): n = A,T,C or G, or insertion/deletion polymorphism (see Tables 1-2)
gaaatcgcaggactacaagtccctcaatgccacttgcgccggaggcacttccttttccggttgtgctaggcgcctgctcctgycgacgtgttcttccggtggcggagcggcggattagccttcgcgggncaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcagtc

SEQ ID NO: 628 - DNA, 812 bp, Homo sapiens
  misc_feature (1)...(812): n = A,T,C or G, or insertion/deletion polymorphism (see Tables 1-2)
gttcttccggtggcggagcggcggattagccttcgcgggncaaaatgctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaaggctcctgtgcctgtctccgagcaacacctccacctctgcaccttcacctgggctgtcccacctgcctgaatggccctccccactccctgccagagctctcctctcctaagcctgaaggctgcagccccgggatctgcccctcggatgactggtgtctcagatgtcagcacttcactattcagctggggtggagacctattacatgcctccttggcgcccagactcaggacagcttcagatagaagcagtcgaggggcttgaggccctcgggcgtcttgacgtacttgggctcgcccagcatgccgatgtacactgtcacctggaagtggttcttcttctggcacacaaaggcgtcgtcgcccaccgaaaagttgaagcccttgtccgcatccacgcggtaggtttcacttttatcagtgttcaggaaaaagaacaaactcaacccaagaggtcaacacgtcctgcgtgaaccctgtgctcacccagcaagtggaaggctgtggccatatgggatccagctct

SEQ ID NO: 629 - DNA, 2697 bp, Homo sapiens
  misc_feature (1)...(2697): n = A,T,C or G, or insertion/deletion polymorphism (see Tables 1-2)
atgggggcgtgggccctggcaagtgcactcctcagccaatcagcgtcctgcccggctggtggattcggttacaagcccaagatcaccccatactccagcctctttcctcctcctcccgcagctccattcattggtcccgccgcaccgggcctgctgggctccgcttccgttccactgctcagctgccgcctggtggggccaccaagggcaggcatcccaggggctttgtctgactggactgggccagtgcagaatgggggttcaggcagggctgtttgggatgctgggcttcctgggggtggccctggggggctcccctgccctccgctggtacaggacctcctgccacttgaccaaggccgtccctggcaacccactggggtacctgagcttcctggccaaggatgctcagggactggccctgatccatgcccgctgggatgcgcataggaggctgcagncatgtagctgggaggatgagccggagctcaccgcagcctacggtgctctctgtgctcatgagactgcctggggctccttcatccacacccccggacccgagctgcagagagcactggccactcttcagagtcagtggsaggcatgccgagcgcttgaggagagtccagcaggggccaggaagaagcgagcagcagggcagagtggagtccctggtggagggcaccagcgagagaagagaggatggaccatgcctggcacastgtggtgtggagttggagattctgctgggaactcctcggagctgggggtcttccagggacctgatctctgttgccgggaacatgaccgctgcccacagaacatctcacccttgcagtacaactatggcatccgaaactaccgattccacaccatctcccactgtgactgtgacaccaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtgtaggatgtayggcacagtgcccctcgctcgcctgcagcccaggaccttctacaatgcctcctggagctcccgggccacctccccaactcccagctcccggagcccagcccctcccaagcctcgacagaagcagcaccttcggaaggggccaccacatcagaaagggtccaagcgccccagsaaagccaacaccacagccctccaggaccctatggtctctcccaggcttgatgtggcccccacaggcctccagggcccacagggtggcctaaaacctcagggtgcccgctgggtctgccgcagcttccgccgccacctggaccagtgtgagcaccagattgggccccrggaaatcgagttccagctgctcaacagcgcccaagagcccctcttccactgcaactgcacgcgccgtctggcacgcttcctgaggctccacagcccacccgaggttaccaacatgctttgggagctgctgggcacaacctgcttcaagctggcccctccactggactgtgtggaaggcaaaaactgttccagagaccctagggccatcagggtgtcagcccggcacttgcggaggcttcagcagaggcgacaccagctccaggataaaggcacagatgagaggcagccatggccttcagagcccctgagaggccccatgtcattctacaaccagtgcctgcagctaacccaggcagccaggagacccgacaggcagcagaagtcctggagccagtgacctcagtttcagctttcctgggcaccagcctggaccttgcccatggctatgccaagccttgggaatctcagcctcccctccgtaggttagactgaagcatrgcagaggctgttgtggacaatcaagaggatgaatggggggatctcaaggcccaaatgctggaccacatctcctgctgttctgggtaaccttgagctatgtatgacacaactcttctatgcctggatgtggtgttcaggaagctcattctgatgccctgggctttggccttgccagggaacttcacatacagatgagaatggggaaagggtaacttattgcagcagccccaggcagtaccaggaggaggtacatgtatgtccgtgttgcaaaaataatacatgcctcaaaaacctgcctaggggagccctagtgcctgggtgctgtggcctgaggtagcaggtgggaagttagggatgtcacagaaatgtctgtgtctgaatccaggattggggtgggtgttggagagggctttcagctcccctcctcccaggggggcctctttttttaacggctgccntgcccttcctggcccanccctaaacctaaattcaaatctcctccatgcctttgcgcaaaggacctccctcttgcactctaagccttagtttcctcctctaaaaaaagggggtctctaaacaggagctacctcatagggttgttgaggattaagtgaaccaatacatatacagtgcttagcacttaataagtantcccccctgcgacacctagctgaactatggtttggtgtctgatcttgagaggttgatgtaaccttttaaaggcctcagttcgctcacctgtgaaatgggtctaagaatagcactgatctcacagggttgtgatgcagattaaaggagatggcatgtgtaatg

SEQ ID NO: 630 - DNA, 2680 bp, Homo sapiens
  misc_feature (1)...(2680): n = A,T,C or G, or insertion/deletion polymorphism (see Tables 1-2)
atcagacagtaaaacaggggcagagcctggaatygcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggwagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacargcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagccngcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatytcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagactttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagnggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactacngacccscccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 631 - DNA, 2523 bp, Homo sapiens
  misc_feature (1)...(2523): n = A,T,C or G, or insertion/deletion polymorphism (see Tables 1-2)
cccggatgtctggtctgcggctgctcctctaagtgcagcagcaaggaggctgggcctggactgcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggwagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacargcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagccngcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatytcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagactttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagnggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactacngacccscccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 632 - DNA, 2514 bp, Homo sapiens
  misc_feature (1)...(2514): n = A,T,C or G, or insertion/deletion polymorphism (see Tables 1-2)
tgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggwagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacargcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagccngcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatytcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagactttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagnggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactacngacccscccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcacca

SEQ ID NO: 633 - DNA, 3874 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 634 - DNA, 3736 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 635 - DNA, 3809 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 636 - DNA, 3011 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaatagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 637 - DNA, 3061 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattct

SEQ ID NO: 638 - DNA, 2873 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaatagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 639 - DNA, 2946 bp, Homo sapiens
acacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaatagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 640 - DNA, 3213 bp, Homo sapiens
taaaaatacagaccacgtttacagctaaagctgagatagatgtgtccgggaaggyagtcgtcgccagacaagttgtaagaacgaatttaaaaatctctgcaaagacatccgagagggtcgasggtagatgtggtgattgggagctgaaaaggatttttcttccgtattcrgacataatagacatgatgcaaactaaagtacagaacaagaaaaggcaagtggctttcttcattttattgatgctttggggagaggtgggttctgaatcgattcagtattccgtattggaggagacagaaagtggcacgtttgtggccaacttgacaaaggacctgggactgagggtgggggagctggcttcgcggggcgctcgggttgttttcaaagggaacagacaacatttgcagtttgatccacagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaarttcccggagctggtgctagacaaaccgttggaccgcgaggagcagccccaactcaggctaacgctgatcgcgctggatggcgggtctccgccccggtcagggacctccgagattcagatccagrttttsgacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaackcaatcacaggagaaattcggctgagaaaggctttggattttgaggaaattcagtcttatgacgtggatgttgaggctacagatggtggaggcctatcaggaaaatgctctttagtcgtcagggtcctggacgtsaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgcccccgccttcacccaaacctcctacaccctgttcgtccgsgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgttygccctcaggtcgctggactacgaggccctgcagtctttcgagttccgcgtgggcgccacagaccgcggctccccggcgttgagcagmgaggcgctggtgcgcttgctggtgctggacgccaacgacaactcgcccttcgtgytgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcycggtctgttcggcgtgtgggcgcacaatggcgaggtgcgcaccgccaggctgctgagcgagcgagacgcagccaagcasaggctggtggtgcttgtcaaggacaatggcgagcctccgcgctcggccaccgccacgctgcacgtgctcctggtggacggcttctcccagccctacctgcctctccctgaggcggcmccggcccaagcccaggccgactctytcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttccccccccccaaaaaaaagtattgtaaatccttaagtaaaattgtatttctagctattggtaagagttgtttcactattgctatgtaggactgtttaaaatgtgagtatctgatattatttaatcctccaatgtctcattttgcagtaactcctacagtgtgtaacactaaaaataagaactaatgatggctaaacactaaagtagccattcatacttatgcatattttagtatcccataatagtcaatccaaaatttttgtgactatagactttactgaagtgtcaacacattagtttgtgagcctcatgtaagaacatgatggtctttttttaaaaaaaaagtcgtgccaattataagtgcttaataaatatttgctgaatgttactaa

SEQ ID NO: 641 - DNA, 1132 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaat

SEQ ID NO: 642 - DNA, 984 bp, Homo sapiens
aggggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaat

SEQ ID NO: 643 - DNA, 1195 bp, Homo sapiens
aggggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcag

SEQ ID NO: 644 - DNA, 997 bp, Homo sapiens
aggggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcag

SEQ ID NO: 645 - DNA, 691 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcag

SEQ ID NO: 646 - DNA, 850 bp, Homo sapiens
caattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcag

SEQ ID NO: 647 - DNA, 1448 bp, Homo sapiens
aggggaaaggggaagtttgggaggaaggcttctgagaagactggtgggagagaaggagagcctgcagacagaggcctccagcttggaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcak

SEQ ID NO: 648 - DNA, 1363 bp, Homo sapiens
gaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcak

SEQ ID NO: 649 - DNA, 629 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacaggcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcag

SEQ ID NO: 650 - DNA, 1360 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcaygtggaggtgaggtggtaccgctcagagcccagcacacctgtgtttgtgcacagggatggagtggaggtgactgagatgcagatggaggagtacagaggcwgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctarcatccacatggagggacctggggagagtggagtccagcttgtgtgcactgcaaggggctggttcccwgagccccaggtgtattgggaagacatccrgggagagaagctgctggccgtgtctgagcatcgcatccaagatraagatggcctgttctatgyggaagccaccctggtggtcagraacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtrctggtgagtgacgccattgacgagggcagactgaccctgcagatactcagtgccagaccttcggacgacgggcagtaccgctgcctttttgaaaaagatgatgtctaccargaggccagtttggatctgaaggtggtargtctgggttcttccccactgatcactgtggaggggcaagaagatggagaaatgcagcygatrtgctcttcagatgggtggttcccacagccccacgtgcmrtggagggacatggaaggaaagacgataccatcmtcttcccaggccctgactcaaggcagccaygggctgttccacgtgcagacattgctaagggtcacaaacatctccgctgtggacgtcacttgttccatcagcatcccctttttgggcgaggagaaaatcgcaactttttctctctcag

SEQ ID NO: 651 - DNA, 1431 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcaygtggaggtgaggtggtaccgctcagagcccagcacacctgtgtttgtgcacagggatggagtggaggtgactgagatgcagatggaggagtacagaggcwgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctarcatccacatggagggacctggggagagtggagtccagcttgtgtgcactgcaaggggctggttcccwgagccccaggtgtattgggaagacatccrgggagagaagctgctggccgtgtctgagcatcgcatccaagatraagatggcctgttctatgyggaagccaccctggtggtcagraacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtrctggtgagtgacgccattgacgagggcagactgaccctgcagatactcagtgccagaccttcggacgacgggcagtaccgctgcctttttgaaaaagatgatgtctaccargaggccagtttggatctgaaggtggtargtctgggttcttccccactgatcactgtggaggggcaagaagatggagaaatgcagcygatrtgctcttcagatgggtggttcccacagccccacgtgcmrtggagggacatggaaggaaagacgataccatcmtcttcccaggccctgactcaaggcagccaygggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctg

SEQ ID NO: 652 - DNA, 1368 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcaygtggaggtgaggtggtaccgctcagagcccagcacacctgtgtttgtgcacagggatggagtggaggtgactgagatgcagatggaggagtacagaggcwgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctarcatccacatggagggacctggggagagtggagtccagcttgtgtgcactgcaaggggctggttcccwgagccccaggtgtattgggaagacatccrgggagagaagctgctggccgtgtctgagcatcgcatccaagatraagatggcctgttctatgyggaagccaccctggtggtcagraacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtrctggtgagtgacgccattgacgagggcagactgaccctgcagatactcagtgccagaccttcggacgacgggcagtaccgctgcctttttgaaaaagatgatgtctaccargaggccagtttggatctgaaggtggtargtctgggttcttccccactgatcactgtggaggggcaagaagatggagaaatgcagcygatrtgctcttcagatgggtggttcccacagccccacgtgcmrtggagggacatggaaggaaagacgataccatcmtcttcccaggccctgactcaaggcagccaygggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 653 - DNA, 519 bp, Homo sapiens
atgaaaccccagtttgttgggatcktgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagasaaacatccttctgtgagtcattaaaatctatgaaccactctaca

SEQ ID NO: 654 - DNA, 1359 bp, Homo sapiens
ctccagaccagcgagtgtgggcctttatctggactctgcttcctccctggggacaccaggtcttggagcaagagaacttggcaggctctccccatggcagtcttattcctcctcctgttcctatgtggaactccccaggctgcagacaacatgcaggccatctatgtggccttgggggaggcagtagagctgccatgtccctcaccayctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttgsagggatccaaagaggaagatgccgggcggtactggtgcrctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgargggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccagrcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagasaaacatccttctgtgagtcattaaaatctatgaaccactctaca

SEQ ID NO: 655 - DNA, 992 bp, Homo sapiens
gagaacttggcaggctctccccatggcagtcttattcctcctcctgttcctatgtggaactccccaggctgcagacaacatgcaggccatctatgtggccttgggggaggcagtagagctgccatgtccctcaccayctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttgsagggatccaaagaggaagatgccgggcggtactggtgcrctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgargggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccagrcagagatgcctcgattcctcagttcaaacccgaaatccaggtctatgagaacatccatttggcccgtcttggcccacctgcccacaagcccaggtgattttggtgacatctgctgggaagtgtgacctgctgtctcgctggccatctggcacctggaagattcctcgacaacc

SEQ ID NO: 656 - DNA, 1288 bp, Homo sapiens
gagaacttggcaggctctccccatggcagtcttattcctcctcctgttcctatgtggaactccccaggctgcagacaacatgcaggccatctatgtggccttgggggaggcagtagagctgccatgtccctcaccayctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttgsagggatccaaagaggaagatgccgggcggtactggtgcrctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgargggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccagrcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagasaaacatccttctgtgagtcattaaaatctatgaaccactctaca

SEQ ID NO: 657 - DNA, 2748 bp, Homo sapiens
tgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgacccygacctgcactttgatgctgagcgactgggtcagggacrcgcgcrcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccrattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctrgcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcragacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcmacccctagacccttctccctggagctgattgkccaggacgcagcggggcggygcctgcacagggctgcccctcagcctagcactgtagtccctgtccttctggagcttagtggcccctcgggtttcttggccccgggcagcaaagtcccrctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattcygtggtgatggtgactgtgactgcagggggacgagaagccaacccagtacccccgactcatgctttcctccggctcctggtatcggccccagccccgcaggtgaggaacyactactttccatcacagggaccggcacaccacccctaccggctcatctga

SEQ ID NO: 658 - DNA, 2629 bp, Homo sapiens
tgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgacccygacctgcactttgatgctgagcgactgggtcagggacrcgcgcrcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccrattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctrgcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcragacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcmacccctagacccttctccctggagctgattgkccaggacgcagcggggcggygcctgcacagggctgcccctcagcctagcactgtagtccctgtccttctggagcttagtggcccctcgggtttcttggccccgggcagcaaagtcccrctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattcygtggtgatggtgactgtgactgcagggggacgagaagccaacccagtacccccgactcatgctttcctccggctcctggtatcggccccagccccgcaggtgaggaacyactactttccatcacagggaccggcacaccacccctaccggctcatctga

SEQ ID NO: 659 - DNA, 2574 bp, Homo sapiens
gtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgacccygacctgcactttgatgctgagcgactgggtcagggacrcgcgcrcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccrattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctrgcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcragacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcmacccctagacccttctccctggagctgattgkccaggacgcagcggggcggygcctgcacagggctgcccctcagcctagcactgtagtccctgtccttctggagcttagtggcccctcgggtttcttggccccgggcagcaaagtcccrctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattcygtggtgatggtgactgtgactgcagggggacgagaagccaacccagtacccccgactcatgctttcctccggctcctggtatcggccccagccccgcaggtgaggaacyactactttccatcacagggaccggcacaccacccctaccggctcatctga

SEQ ID NO: 660 - DNA, 2076 bp, Homo sapiens
ctgaaaatgtcgcaactcgcccggaggcggagccggtacgggctgacgtcaagggcacacaacmcctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagayaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctrggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggccygacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtgkaaagtgggggaccatcccccttctcaccactgttcctcttgcacgtttcccctcattcatgtggctgtacttaaccttctccaayatacatcctgcattacatgaatggattattcctaataattaataaaaaggtattttttctactatcwggctaat

SEQ ID NO: 661 - DNA, 2009 bp, Homo sapiens
ctgaaaatgtcgcaactcgcccggaggcggagccggtacgggctgacgtcaagggcacacaacmcctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagayaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctrggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggccygacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtgkaaagtgggggaccatcccccttctcaccactgttcctcttgcacgtttcccctcattcatgtggctgtacttaaccttctccaayatacatcctgcattacatgaatggattattcctaataattaataaaaaggtattttttctactatcwggctaat

SEQ ID NO: 662 - DNA, 2271 bp, Homo sapiens
cataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctwtcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagayaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctrggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggccygacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtgkaaagtgggggaccatcccccttctcaccactgttcctcttgcacgtttcccctcattcatgtggctgtacttaaccttctccaayatacatcctgcattacatgaatggattattcctaataattaataaaaaggtattttttctactatcwggctaat

SEQ ID NO: 663 - DNA, 1960 bp, Homo sapiens
gctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtattctggtccatctcttattactcctctcccttcgccttcttctacttgtacaggaaaggttacttgagtttgtccaaagtggtgccgttttctcactatgctgggacattgctgctacttctggcaggtgtggcctgcctccgaggcattggccgctggaccaacccccagtaccggcagttcatcaccatcttggaagcaacacatcggaaccagtcttcagaaaacaagaggcagcttgccaactacaactttgacttccggagctggccagtcgacttccactgggaagaacccagcagccggaaggagtctcgagggggcccttcccgccggggtgtggccctgcttcgcccagagcccctgcaccgggggacagcagayaccctcctcaaccgggttaagaagctgccttgtcagatcaccagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctrggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggccygacttcccctggagcgtgggggaggacatgagtgcagatggacggcggcagctggctttgtttctggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtgkaaagtgggggaccatcccccttctcaccactgttcctcttgcacgtttcccctcattcatgtggctgtacttaaccttctccaayatacatcctgcattacatgaatggattattcctaataattaataaaaaggtattttttctact

SEQ ID NO: 664 - DNA, 2543 bp, Homo sapiens
tagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaargttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaa

SEQ ID NO: 665 - DNA, 1513 bp, Homo sapiens
atgaatcaggaagacccagggtggagaggaggagtagtcgcccaaggtccttggccattcctattgtgtgtccctgccttatgggagaccacgtggaggtcagctatgatgctttcctgctgcttattgtgggtattgcctttcagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaattgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaa

SEQ ID NO: 666 - DNA, 2007 bp, Homo sapiens
gtgcggtggagcgaaatttgaagcaagcggaggcggggcgctctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtcctttgagacagcaccaagtcggacctgcccacagtgccgaatccaggttggcaaaagaaccattatcaataagctcttctttgatcttgcccaggaggaggagaatgtcttggatcgagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcgggccggctcaggagcaagatgaagaccatggagcagattgagcttctactccagagccagctccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaaaaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcagggtttgtggacagagccctaytttcgggaccagcctgaggtgtaagggcagacaaacaggtgagggtgagtgtgacrcccagagactgctcttcctgccctcaccctgccccactcctacgactgggagctgacatgaccagcccactgatcctgtcagcaggtcctgctctgttgccaggctcttgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctagcatagcctgggccaagcagggtggggaatggaggatagacatgggatgtatggagaggatggaagattttcccgaaaaaaaaaaaaaaaaaaaaaaa

SEQ ID NO: 667 - DNA, 984 bp, Homo sapiens
ggcgaagtcgtcaccggcgccgttagtccccgggttgggagggccctgcggagcctgacccagcgtggctgcagcgccccctgcgtcccggagggcaccgcacagctcgaccggcccagcaggcgagttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctrtgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcrgaagttggttgacaaggctccactcagacaggccacagaggctccaatacctgggaatgttcacaaagtcatcaactggaaaaaaagcaaaaacccacggccaaaataaattggtactgtttgttac

SEQ ID NO: 668 - DNA, 1939 bp, Homo sapiens
ggggtgtccccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctrtgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcrgaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttac

SEQ ID NO: 669 - DNA, 1727 bp, Homo sapiens
ccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctrtgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcrgaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttac

SEQ ID NO: 670 - protein, 1464 aa, Homo sapiens [sequence omitted]

SEQ ID NO: 671 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 672 - protein, 894 aa, Homo sapiens; identical to SEQ ID NO: 671

SEQ ID NO: 673 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 674 - protein, 485 aa, Homo sapiens [sequence omitted]

SEQ ID NO: 675 - protein, 599 aa, Homo sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 676 - protein, 343 aa, Homo sapiens [sequence omitted]

SEQ ID NO: 677 - protein, 209 aa, Homo sapiens [sequence omitted]

SEQ ID NO: 678 - protein, 209 aa, Homo sapiens [sequence omitted]

SEQ ID NO: 679 - protein, 158 aa, Homo sapiens
MEGETSSSPCLQENSADCSAGELRGPGKELWSPIQQVTATSSKWARFVLPPRKSSHVDSEQPRSLQRDPRPAGPAQAKQGTPRAQASREGLSRPTAAVQLPRATHPVTSGSERPCGKTSWDARTPWAEGGPLVLEAQNPRPTRLCDLFITGEDFDDDV

SEQ ID NO: 680 - protein, 394 aa, Homo sapiens [sequence omitted]

SEQ ID NO: 681 - protein, 310 aa, Homo sapiens [sequence omitted]

SEQ ID NO: 682 - protein, 440 aa, Homo sapiens
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 683 - protein, 216 aa, Homo sapiens
MADHLISGGTGYVPQDWLTVQQLFLGANCRTHNNFLILPWFIDFIADEVDLTSALTRKIMLKTPLISSPMDTETEADMAIAMALMGGIGFIHHNCTPEFQANEVHKVKKFEQGFITDPVVLSPSHTVGDVLEAKIRHGFSCILITEMGTMGSKLVGIISSRDINFLAEKDHTTLLSEVMTPRIKLMVAPAGMTLKQANEILQPSKGSCLWSMIAMS

SEQ ID NO: 684 - protein, 362 aa, Homo sapiens
MRVTAPRTVLLLLWGAVALTETWAGSHSMRYFYTAMSRPGRGEPRFITVGYVDDTQFVRFDSDATSPRMAPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQQRAYLEGTCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 685 - protein, 406 aa, Homo sapiens
MRVTAPRTVLLLLWGAVALTETWAGSHSMRYFYTAMSRPGRGEPRFITVGYVDDTQFVRFDSDATSPRMAPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQQRAYLEGTCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWGKEGDEGSYLFSGKAGALQQGQGPSSSPPFPEPSSQSTVPIVGIVAGLAVLAVVVIGAVVAAVMCRRKSSGREGVRGGVWVFLSHWGFQAPGRSVPCLITGKQHPHRG

SEQ ID NO: 686 - protein, 241 aa, Homo sapiens
MYGCDVGPDGRLLRGYDQDAYDGKDYIALNEDLSSWTAADTAAQITQRKWEAARVAEQQRAYLEGTCVEWLRRYLENGKETLQRADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 687 - protein, 224 aa, Homo sapiens
MRVTAPRTVLLLLWGAVALTETWAGSHSMRYFYTAMSRPGRGEPRFITVGYVDDTQFVRFDSDATSPRMAPRAPWIEQEGPEYWDRETQISKTNTQTYRENLRTALRYYNQSEAGSHIIQRMYGCDVGPDGRLLRGYDQDAYDGKDYIALNEDLSSWTAADTAAQITQRKWEAARVAEQQRAYLEGTCVEWLRRYLENGKETLQRADQEQKSLFPAQRLELSNE

SEQ ID NO: 688 - protein, 132 aa, Homo sapiens
MLLRMSEHRNEALGNYLEMRLKSSFLRGLGSWKSNPLRLGGWTILLTLTMGQGEPGGPQGDPWVPHELLLPSLCDSSHASSWGSGSITCAWRGGDSSSHPLVSGHILSNSPVAAVMCSSMGTHLSPFKGTLL

SEQ ID NO: 689 - protein, 132 aa, Homo sapiens; identical to SEQ ID NO: 688

SEQ ID NO: 690 - protein, 143 aa, Homo sapiens
MCPRKWSCFGVPGVTHHPLEQPERSRASAPMLLRMSEHRNEALGNYLEMRLKSSFLRGLGSWKSNPLRLGGWTILLTLTMGQGEPGGPRIPGFHTNSSYPHCVTAAMPPPGDQDLLPVPGEEGTPLLTRWSLDTYCPIPLWQL

SEQ ID NO: 691 - protein, 890 aa, Homo sapiens [sequence omitted]

SEQ ID NO: 692 - protein, 813 aa, Homo sapiens
MIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKLDDLGLRLPSPTFSVMDVERYVGGDKVIDVIDVARQADSKMTLHNYVKYFMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGKRPKKGMATAKQRLGKILKLNRNGHARFFV

SEQ ID NO: 693 - protein, 361 aa, Homo sapiens [sequence omitted]

SEQ ID NO: 694 - protein, 349 aa, Homo sapiens
METPPVNTIGEKDTSQPQQEWEKNLRENLDSVIQIRQQPRDPPTETLELEVSPDPASQILEHTQGAEKLVAELEGDSHKSHGSTSQMPEALQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 695 - protein, 349 aa, Homo sapiens; identical to SEQ ID NO: 694

SEQ ID NO: 696 - protein, 134 aa, Homo sapiens [sequence omitted]

SEQ ID NO: 697 - protein, 145 aa, Homo sapiens
MILILQMRKMRHKEVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 698 - protein, 206 aa, Homo sapiens
MAQQACPRAMAKNGLVICILVITLLLDQTTSHTSRLKARKHSKRRVRDKDGDLKTQIEKLWTEVNALKEIQALQTVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 699 - protein, 248 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 700 - protein, 248 aa, Homo sapiens; identical to SEQ ID NO: 699

SEQ ID NO: 701 - protein, 1226 aa, Homo sapiens
MDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGSRGFKQEVVGRELGAPEHLQLLLGGGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKRMTWFHMDCQDLMAQLRLDKTSRVSPGDQRRLHRYLQRLASEFPAEKLAAVGLQVASLSRAGLGQELWEEARIRHEEIRMLLEKALTHSSCPEAPAAHSARPERRGVAAKGQGVSVEVTSKGRWDQPPLDSLGMDHLPKSYWPPGPPRGEQNRTFQAGSPPQEAGQAAEAEDGKGSHKLPDPAREHLLATTFFRQQPPRQSQVPRLTGGSFSSEGTDSQTSLEDSPQTSPLASL

SEQ ID NO: 702 - protein, 1200 aa, Homo sapiens
MDPPSLDTAIQHALAGLYPPFEATAPTVLGQVFRLLDSGFQGDGLSFLLDFLIPAKRLCEQVREAACAPYSHCLFLHEGWPLCLRDEVVVHLAPLNPLLLRQGDFYLQVEPQEEQSVCIMIKCLSLDLCTVDKKPVPEPAYPILFTQEWLEAINSDFEGNPLHNCLVASENGIAPVPWTKITSPEFVDDRPQVVNALCQAWGPLPLEALDLSSPQELHQASSPDNQVLPAQSLAKGKGRTYGSKYPGLIKVEQARCGEVAFRMDEVVSQDFEGDYVALLGFSQESRGESPSREAGTSSGCTSGALEEIAGTKETPLFQKILPLSEANEGPSLGNRACTKPESSEERPYNLGFRRKVNLKAPTHNSERPPQGSYMNVLEDALDCASGLRAGVSQEPAASKMQGPLGNPENMVQLRPGPRQASSPRLSPASPAAAASETKIEVKTKERNGRLPKPMPCPSRNTSSPEPPTPGLKFSFLRGQRQPSVTPEKASLQHNGPWKVLCSLYSPKPNRAKSLGKAGTTQTKTSGPATAPSPLTEEKAALPEASAGSPERGPTLEEEPPGPEPRIGALGVKVFRSRIACLPGGRDRAGRPLLLVSTTEGAWEAPWCTVSEVTKLLSYLCTIPRPEDKAKGLAVLIDARRQPPQPGLVSALQATQAQVPASIRAILFLGEKEAALQLQTLPDVQVEVLTSLKALSHHVDPSQLPAVLEGPFPYCHTEWVHFFQKLDPFLADLHQASSLLQASIEEFEKADPPGGMQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAAQYRRGLELSKQAAQLGATARGAGEAERAEFPELAAFASTQRAFQAELTHFYMAAERQRTDLETLLHLHRFCKRMTWFHMDCQDLMAQLRLDKTSRVSPGDQRRLHRYLQRLASEFPAEKLAAVGLQVASLSRAGLGQELWEEARIRHEEIRMLLEKALTHSSCPEAPAAHSARPERRGVAAKGQGVSVEVTSKGRWDQPPLDSLGMDHLPKSYWPPGPPRGEQNRTFQAGSPPQEAGQAAEAEDGKGSHKLPDPAREHLLATTFFRQQPPRQSQVPRLTGGSFSSEGTDSQTSLEDSPQTSPLASL

SEQ ID NO: 703 - protein, 221 aa, Homo sapiens
MPNWELDLIWVWGALEGCRGRVGMGPQGTSLRWQEATRCLSKSKELMEAVLRDPGLLGLQREGGATLARLQHDASRLDFSPDVRSHLAAATALYSLVDEQLHVLVTASNSLLGKLELRVRLGRLEAAIHQVSDWMEQEGRRCLQSLTPKDGSLETVEKAHAEFENFFLQAAVRSRQQRSRTGADGEGVRGGGTARAKLWRWERARKVPETVREPAWIAEFS

SEQ ID NO: 704 - protein, 221 aa, Homo sapiens [sequence omitted]

SEQ ID NO: 705 - protein, 207 aa, Homo sapiens
MSETVPAASASAGVAAMEKLPTKKRGRKPAGLISASRKVPNLSVSKLITEALSVSQERVGMSLVALKKALAAAGYDVEKNNSRIKLSLKSLVNKGILVQTRGTGASGSFKLSKKVIPKSTRSKAKKSVSAKTKKLVLSRDSKSPKTAKTNKRAKKPRATTPKTVRSGRKAKGAKGKQQQKSPVKARASKSKLTQHHEVNVRKATSKK

SEQ ID NO: 706 - protein, 1049 aa, Homo sapiens
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 707 - protein, 675 aa, Homo sapiens [sequence omitted]

SEQ ID NO: 708 - protein, 458 aa, Homo sapiens [sequence omitted]

SEQ ID NO: 709 - protein, 458 aa, Homo sapiens [sequence omitted]

SEQ ID NO: 710 - protein, 458 aa, Homo sapiens
MASTITGSQDCIVNHRGEVDGEPELDISPCQQWGEASSPISRNRDSVMTLQSGCFENIESETYLPLKVSSQIDTQDSSVKFCKNEPQDHQESRRLFVMEESTERKVIKGESCSENLQVKLVSDGQELASPLLNGEATCQNGQLKESLDPIDCNCKDIHGWKSQVVSCSQQRGHTEEKPCDHNNCGKILNTSPDGHPYEKIHTAEKQYEGSQCGKNFSQSSELLLHQRDHTEEKPYKCEQCGKGFTRSSSLLIHQAVHTDEKPYKCEKCGKGFTRSSSLLIHHAVHTGEKPYKCDKCGKGFSQSSKLHIHQRVHTGEKPYECEECGMSFSQRSNLHIHQRDHTGERPYKCGECGKGFSQSSNLHIHRCIHTGEKPYQCYECGKGFSQSSDLRIHLRVHTGEKPYHCGKCGKGFSQSSKLLIHQRVHTGEKPYECSKCGKGFSQSSNLHSHQRVHKKDPR

SEQ ID NO: 711 - protein, 241 aa, Homo sapiens
CGLPWEAPAPMKAPGAGLAGKPSPWAPPGRAAATVPAAPLQLSNGGCSPPPPVLDGEDALPDLDLVPPPPLPPPVLLSSEEEAPAPMGASLIADLERLHLPSPPPRPQAPVEGPSVQPGPSPLGPGEEELPPSPAEPVERESSTDICAFCHKTVSPARAGCGGHKEAVPCPVLHVAHLPPPASWAELLPGWATPLQTLLPGHTGEVRQVWPGGPGAHHQGPGPGLPPLLLHVCDLCPVHPG

SEQ ID NO: 712 - protein, 226 aa, Homo sapiens
MNNSQISTVTQFVLLGFPGPWKIQIIFFSMILLVYIFTLTGNMAIICAVRWDHRLHTPMYVLLANFSFLEIWYVTCTVPNMLVNFFSKTKTISFSGCFTQFHFFFSLGTTECFFLCVMAYDRYLAICHPLHYPSIMTGQLCGILVSLCWLIGFLGHSISIFFIFQLPFCGPNIIDHFLCDVDPLMALSSAPTHIIGHVFHSVSSLFINLTMVYILGSYTLVLRTVL

SEQ ID NO: 713 - protein, 93 aa, Homo sapiens
MKPVLPLQFLVVFCLALQLVPGSPKQRVLKYILEPPPCISAPENCTHLCTMQEDCEKGFQCCSSFCGIVCSSETFQKRNRIKHKGSEVIMPAN

SEQ ID NO: 714 - protein, 90 aa, Homo sapiens
MKPVLPLQFLVVFCLALQLVPGSPKQRVLKYILEPPPCISAPENCTHLCTMQEDCEKGFQCCSSFCGIVCSSETFQKRNRPLRCFFLVHL

SEQ ID NO: 715 - protein, 601 aa, Homo sapiens
MDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALEYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHIDLFVDVNKHLFDGEVCAINHFVKLLKDIIICFLNIRAKNVAQNPLKHHSERTDMKTLSRKHWSSVQDYKCSSFANTSSKFRHLLSNDGYPFK

SEQ ID NO: 716 - protein, 692 aa, Homo sapiens [sequence omitted]

SEQ ID NO: 717 - protein, 495 aa, Homo sapiens
MPQLLQNINGIIEAFRRYARTEGNCTALTRGELKRLLEQEFADVIVKPHDPATVDEVLRLLDEDHTGTVEFKEFLVLVFKVAQACFKTLSESAEGACGSQESGSLHSGASQELGEGQRSGTEVGRAGKGQHYEGSSHRQSQQGSRGQNRPGVQTQGQATGSAWVSSYDRQAESQSQERISPQIQLSGQTEQTQKAGEGKRNQTTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEWSSTHPRRCVTEGQGDRQPTVVGEEWVDDHSRETVILRLDQGNLHTSVSSAQGQDAAQSEEKRGITARELYSYLRSTKP

SEQ ID NO: 718 - protein, 237 aa, Homo sapiens
MLEEDMEVAIKMVVVGNGAVGKSSMIQRYCKGIFTKDYKKTIGVDFLERQIQVNDEDVRLMLWDTAGQEEFDAITKAYYRGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIGVFNTSGGSHSGQNSGTLNGGDVINLRPNKQRTKKNRNPFSSCSIP

SEQ ID NO: 719 - protein, 173 aa, Homo sapiens
RRWAAAPARRPLPAPSGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIGVFNTSGGSHSGQNSGTLNGGDVINLRPNKQRTKKNRNPFSSCSIP

SEQ ID NO: 720 - protein, 237 aa, Homo sapiens; identical to SEQ ID NO: 718

SEQ ID NO: 721 - protein, 237 aa, Homo sapiens; identical to SEQ ID NO: 718

SEQ ID NO: 722 - protein, 922 aa, Homo sapiens
MERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDFTLVAQAGVQWHDLGSLQPPPPGFNHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 723 - protein, 897 aa, Homo sapiens
MERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 724 - protein, 1253 aa, Homo sapiens
MERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKSRTRSPEKKIKRMVEKSLPSKMTNKTTSKEVSENEKGKKVTTGETSSSNDKIGENVQLSEKRLKQEPEEKVVSNKTEDHKGKELEAADKNKETGRFKPESSSPVKKTLITPGPWKVPSGNKVTGTIGMAEKRQ

SEQ ID NO: 725 - protein, 1125 aa, Homo sapiens
MSKTLKKKRHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENGERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCVDGIPVKGKSHKQVLDLMTTAAPNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWPDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 726 - protein, 920 aa, Homo sapiens
MATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 727 - protein, 690 aa, Homo sapiens
METRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 728 - protein, 920 aa, Homo sapiens; identical to SEQ ID NO: 726

SEQ ID NO: 729 - protein, 963 aa, Homo sapiens
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 730 - protein, 269 aa, Homo sapiens [sequence omitted]

SEQ ID NO: 731 - protein, 269 aa, Homo sapiens
MEVKPPPGCPQPDSGSRRRRWGEEGHDPKEPEQLRKLFIGGLSFETTDDSLREHFEKWGTLTDCLVMRDPQTKRSRGFGFVTYSCVTEVDAAIGARPFKVDGRVVEPKRAVSREDSVKPGAHLTVKKIFVGSIKEDTEEYNLRDYFEKYGKIETIEVMEDRQSGKKRGFASVTFDDHDTVDKIVVQKYHTINGHNCEVKKALAKQVMQPAGSQRGRGGGSGNCMGHRGNFGGGGGNFGRDGNFGGRGGYGGGGGGSRGSYGGGDVDIMD

SEQ ID NO: 732 - protein, 147 aa, Homo sapiens
TIEVPEVTVFSKSPVTLGQPNTLICLVDNIFPPVVNITWLSNGHSVTEGVSETSFLSKSDHSFFKISYLTFLPSDDEIYDCKVEHWGLDEPLLKHWEPEIPAPMSELTETVVCALGLSVGLVGIVVGTVLIIRGLRSVGASRHQGPL

SEQ ID NO: 733 - protein, 152 aa, Homo sapiens
  VARIANT (1)...(152): Xaa = Any Amino Acid
SADHVASCGVNLYQFYGPSGQYTHEFDGDEEFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLX

SEQ ID NO: 734 - protein, 75 aa, Homo sapiens
  VARIANT (1)...(75): Xaa = Any Amino Acid
MCCFLTTEVPEVTVFSKSPVTLGQPNTLICLVDNIFPPVVNITWLSNGQSVTEGVSETSFLSKSDHSFFKISYLX

SEQ ID NO: 735 - protein, 323 aa, Homo sapiens
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 736 - protein, 323 aa, Homo sapiens; identical to SEQ ID NO: 735

SEQ ID NO: 737 - protein, 1058 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 738 - protein, 568 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDAREFGGG

SEQ ID NO: 739 - protein, 1058 aa, Homo sapiens; identical to SEQ ID NO: 737

SEQ ID NO: 740 - protein, 1058 aa, Homo sapiens; identical to SEQ ID NO: 737

SEQ ID NO: 741 - protein, 441 aa, Homo sapiens
MAPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 742 - protein, 441 aa, Homo sapiens; identical to SEQ ID NO: 741

SEQ ID NO: 743 - protein, 402 aa, Homo sapiens
MLENYGNLVSVGLLSSKPKLITQLEQGAEPWTEVREAPSGTHAVEDYWFETKMSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 744 - protein, 317 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVRRKATPLKFGRDDGQPFA

SEQ ID NO: 745 - protein, 465 aa, Homo sapiens [sequence omitted]

SEQ ID NO: 746 - protein, 475 aa, Homo sapiens [sequence omitted]

SEQ ID NO: 747 - protein, 360 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKCEGQGVGWGRPCQEGSQHCWGWVEGWMVKIGI

SEQ ID NO: 748 - protein, 317 aa, Homo sapiens; identical to SEQ ID NO: 744

SEQ ID NO: 749 - protein, 1012 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKCEGQGVSSVQLGKSWSRCDDFTVPREEDWMESDLPKEDLPLPDSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 750 - protein, 770 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 751 - protein, 111 aa, Homo sapiens [sequence omitted]

SEQ ID NO: 752 - protein, 130 aa, Homo sapiens
MGNPQRWASPIHTPPLGPEILRAMPEALGLRPDPATSVPSALSQRFRVLAQELSEKPGRNPRNGPRSSLFTLHHGIPVPELDSLPPTPYLSPWTLLEEKSLQGACCQRVSLPWEWRCRDRVFCCYCLFVF

SEQ ID NO: 753 - protein, 365 aa, Homo sapiens [sequence omitted]

SEQ ID NO: 754 - protein, 365 aa, Homo sapiens [sequence omitted]

SEQ ID NO: 755 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 756 - protein, 167 aa, Homo sapiens
MTCCQTSFCGYPSCSTSGTCGSSCCQPSCCETSCCQPSCCQTSFCGFPSFSTSGTCSSSCCQPSCCETSCCQPSCCQTSSCGTGCGIGGGIGYGQEGSSGAVSTRIRWCRPDCRVEGTCLPPCCVVSCTPPTCCQLHHAEASCCRPSYCGQSCCRPVCCCYSCEPTC

SEQ ID NO: 757 - protein, 219 aa, Homo sapiens
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 758 - protein, 219 aa, Homo sapiens; identical to SEQ ID NO: 757

SEQ ID NO: 759 - protein, 412 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGKSWELCGI

SEQ ID NO: 760 - protein, 387 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGTTGARHHARLTFCVFSRDGVSPC

SEQ ID NO: 761 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 762 - protein, 141 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPAAKHDIVLTS

SEQ ID NO: 763 - protein, 299 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPTVQPFQEGTYLATIHLPYLQGQVTLELAVYSELGDRGLQG

SEQ ID NO: 764 - protein, 448 aa, Homo sapiens; identical to SEQ ID NO: 761

SEQ ID NO: 765 - protein, 423 aa, Homo sapiens
MNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGFNKLIVYILGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 766 - protein, 154 aa, Homo sapiens
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 767 - protein, 152 aa, Homo sapiens
MTCTDQKSHSQRALGTQTPALQGPQLLNTDPSSEETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 768 - protein, 152 aa, Homo sapiens
MTCTDQKSHSQRALGTQTPALQGPQLLNTDPSSKETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 769 - protein, 94 aa, Homo sapiens [sequence omitted]

SEQ ID NO: 770 - protein, 248 aa, Homo sapiens
GSYFGFEKEHAVLSECLHSAQEESRSDAQRTNSVPIPFPGWLLHHALPPAPEARKPGEEPRRPLDRSPPLGQVQPHFTSQDAKSAEDEAPSRHLGKHQPRSAQVGSRLDALQGPKTQHSIHTVTCKSPRQKEDRSPKPPQAPKHPEEHGRQSHSSSSFASGTLQDTWRLLDLGSSPSGVTSQGDSTPELPAPPAADRRPVKMQAGIATPGMKTAAQAKAKTTGASRSHPAKAKGCQGPPKIRNYNIMD

SEQ ID NO: 771 - protein, 199 aa, Homo sapiens
GSYFGFEKEHAVLSECLHSAQEESRSDAQRTNSVPIPFPGWLLHHALPPAPEARKPGEEPRRPLDRSPPLGQVQPHFTSQDAKSAEDEAPSRHLGKHQPRSAQVGSRLDALQGPKTQHSIHTVTCKSPRQKEDRSPKPPQAPKHPEEHGRQSHSSSSFASGTLQDTWRLLDLGSSPSGVTSQGDSTPELHSVLKEAVAA

SEQ ID NO: 772 - protein, 301 aa, Homo sapiens
MGNRLRAELGRPERWLLHHALPPAPEARKPGEEPRRPLDRSPPLGQVQPHFTSQDAKSAEDEAPSRHLGKHQPRSAQVGSRLDALQGPKTQHSIHTVTCKSPRQKEDRSPKPPQAPQHPEEHGRQSHSSSSFASGTLQDMWRLLDLGSSPSGVTSQGDSTPEMGSHYVTQAGLELLGSSSPAALASQSAEMTGVGPTPSLAWSGALHPNMNQEASLVRSAWAPGMRGGMNGGSSSVCKNMQRGPHWSPSQQPCSGIRTVLLSRKERTLLSCFSLPAPVVLVPLLLSGQAVTERAGHAGDIL

SEQ ID NO: 773 - protein, 573 aa, Homo sapiens
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQGWIRCNTTIRKSGFGGITMLFTGYFVLCCSWSFRRLKKLCRPLPWKSTVPPCIGVAKTTGDCRSKTCLD

SEQ ID NO: 774 - protein, 583 aa, Homo sapiens
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKLQRWRK

SEQ ID NO: 775 - protein, 609 aa, Homo sapiens
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHNCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 776 - protein, 78 aa, Homo sapiens
MAASPGSGSANPRKFSEKIALHTQRQAEETRAFEQLMTDLTLSRVQFQKLQQLRLTQYHGGSLPNVSQLRSSASEFQV

SEQ ID NO: 777 - protein, 379 aa, Homo sapiens [sequence omitted]

SEQ ID NO: 778 - protein, 386 aa, Homo sapiens [sequence omitted]

SEQ ID NO: 779 - protein, 563 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIPGATGPIKLSQKTIVQTPGPIVQYPGPNAGPPSAPRGPPMAPIIISQRTARIPQVHTMDSSGKITLTPVVILTGYMDEELAKKPCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 780 - protein, 1304 aa, Homo sapiens
MSGGASATGPRRGPPGLEDTTSKKKQKDRANQESKHGDPRKETGSRYVAQAGLEPLASGDPSASASHAAGITGSRHRTRLFFPSSSGSASTPQEEQTKEELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDGKEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 781 - protein, 1318 aa, Homo sapiens [sequence omitted]

SEQ ID NO: 782 - protein, 461 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGVFYLSFHPF

SEQ ID NO: 783 - protein, 636 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKRSQGQEFETSLANMEHMILCRFADQTAVQLPPQRRLIGKQCMCLVDLDRARAAEECGYSVQVISMEPESCSPKNNMIVGVPI

SEQ ID NO: 784 - protein, 308 aa, Homo sapiens
MAMDNVTAVFQFLLIGISNYPQWRDTFFTLVLIIYLSTLLGNGFMIFLIHFDPNLHTPIYFFLSNLSFLDLCYGTASMPQALVHCFSTHPYLSYPRCLAQTSVSLALATAECLLLAAMAYDRVVAISNPLRYSVVMNGPVCVCLVATSWGTSLVLTAMLILSLRLHFCGANVINHFACEILSLIKLTCSDTSLNEFMILITSIFTLLLPFGFVLLSYIRIAMAIIRIRSLQGRLKAFTTCGSHLTVVTIFYGSAISMYMKTQSKSYPDQDKFISVFYGALTPMLNPLIYSLRKKDVKRAIRKVMLKRT

SEQ ID NO: 785 - protein, 294 aa, Homo sapiens
MAGILASGLGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 786 - protein, 300 aa, Homo sapiens
MEQANPLRPDGESKGGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 787 - protein, 300 aa, Homo sapiens; identical to SEQ ID NO: 786

SEQ ID NO: 788 - protein, 189 aa, Homo sapiens
MKTRASAVSDPGGLKLRDSLVLDMGFLATPWAPCIRQCPYHISTPVSYTWHQEGFLLLRLPLLEKNRSGRPQQSSPPKTPTAVLNAVDITALATGTLQSSASLPSADVAAPRLCRLCPNQNGNHIIPPSAQIVLTHLRKLKSSSIFSNHNGMKLEINRRKTRKFTNIVMCSIITFPSGTNCIYYCGPIR

SEQ ID NO: 789 - protein, 679 aa, Homo sapiens
MFLGTGEPALDTKAKRKAFHKPPPTSPKSPYLSKPRKVASWRSLRTAGSMPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 790 - protein, 122 aa, Homo sapiens
MPLLYSLGRASGSHPPHLQLQLGWWIFSANRHICRELADAREPCSDTFSDSTLPPAHDLDREELLSATSADTMPPLPGDTLNNQDLLDLSPAGQADTPRCALGRCETGFPHPHSKTRPVPSQ

SEQ ID NO: 791 - protein, 630 aa, Homo sapiens
MPLGGRASLTPQKLWLGTAKPGSLTQALNSPLTWEHAWTGVPGGTPDCLTDTFRVKRPHLRRSASNGHVPGTPVYREKEDMYDEIIELKKSLHVQKSDVDLMRTKLRRLEEENSRKDRQIEQLLDPSRGTDFVRTLAEKRPDASWVINGLKQRILKLEQQCKEKDGTISKLQTDMKTTNLEEMRIAMETYYEEVHRLQTLLASSETTGKKPLGEKKTGAKRQKKMGSALLSLSRSVQELTEENQSLKEDLDRVLSTSPTISKTQGYVEWSKPRLLRRIVELEKKLSVMESSKSHAAEPVRSHPPACLASSSALHRQPRGDRNKDHERLRGAVRDLKEERTALQEQLLQRDLEVKQLLQAKADLEKELECAREGEEERREREEVLREEIQTLTSKLQELQEMKKEEKEDCPEVPHKAQELPAPTPSSRHCEQDWPPDSSEEGLPRPRSPCSDGRRDAAARVLQAQWKVYKHKKKKAVLDEAAVVLQAAFRGHLTRTKLLASKAHGSEPPSVPGLPDQSSPVPRVPSPIAQATGSPVQEEAIVIIQSALRAHLARARHSATGKRTTTAASTRRRSASATHGDASSPPFLAALPDPSPSGPQALAPLPGDDVNSDDSDDIVIAPSLPTKNFPV

SEQ ID NO: 792 - protein, 176 aa, Homo sapiens
IFYLLPSDPLKAQVTLHPISNYEATLRCWALGFYPLEITLTQERDGEDQIQDAEFVETRLAGYRTFQKWAAAVVSSGEKQRYTCHVQHEGLPEPLTLRWGKETNEGSCLFSGKAEVLLEPLSRVRAEAWGSGPLTFTSFLRAVFPAHHPRCGHHCWPGSSSCCNHCSCGRCCDVEE

SEQ ID NO: 793 - protein, 400 aa, Homo sapiens [sequence omitted]

SEQ ID NO: 794 - protein, 104 aa, Homo sapiens
MSGVIKLPRVYVFCDWLPADHVSTYAEFVQTHRPSGEYMFEFDEEEQFYVNLDEKEMVWPLPEFIHTFDFGAQRGIAGIVMARKHLNTRINGPNRLGPQMPPPR

SEQ ID NO: 795 - protein, 117 aa, Homo sapiens
MKFQYKEVHPFEYRKKEGEKIRKKYPDRVPLIVEKAPKARVPDLDRRKYLVPSDLTDGQFYLLIRKRIHLRPEDALFFFVNNTIPPTSATMGQLYEDSHEEDDFLYVAYSNESVYGK

SEQ ID NO: 796 - protein, 197 aa, Homo sapiens
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGEFVRGKPVSRCSDWELHMTMKNGILLYIMAFNRSSFMKGKYPTSKRKKHNSELFAWVLNAVKHWASTYNKGFTAWFCFKTEFVAVQFNLYS

SEQ ID NO: 797 - protein, 228 aa, Homo sapiens
PSYSLPWDSGGVECVLLSAMAYDRYAAVCRPLHYMVSMHPQLCLQLVVTTWLTGFGNSVIQTALTMTLPLCDKNQVDHFFCEVPVMLKLSCTNTSINEAEIFAVSVFFLVVPLSLILASYGHITHAVLKIKSAQGRQKAFGTCGSHLLVVIIFFGTLISMYLQPPSSYSQDVNKSIALFYTLVTPLLNPLIYTLRNKEVKGATKKTSGEDHRCMRKLTQGLQFQTFVH

SEQ ID NO: 798 - protein, 89 aa, Homo sapiens
MVSCERRASKSVGQILLWDFGYTCRLSHRRRNSTEILSRNLPALYTGIKVCEKRPSIDLCIHHCSYFQKCETNKICCSAFCGNICMSIL

SEQ ID NO: 799 - protein, 94 aa, Homo sapiens
MVSCERRASKSVGQILLWDFGYTCRLSHRRRNSTEILSRNLPALYTGSSAGKSVTAWPDLGLTLWSELWHPRLCCLSWFSVCCCCRPREDTVTR

SEQ ID NO: 800 - protein, 103 aa, Homo sapiens [sequence omitted]

SEQ ID NO: 801 - protein, 84 aa, Homo sapiens
SYLLRSLQICSRKWQLMFLETSALTGENVEEAFVQCARKILNKIESGELDPERMGSGIQYGDAALRQLRSPRRAQAPNAQECGC

SEQ ID NO: 802 - protein, 176 aa, Homo sapiens [sequence omitted]

SEQ ID NO: 803 - protein, 84 aa, Homo sapiens
MSQTAMSETYDFLFKFLVIGNAGTGKSCLLHQFIEKKFKDDSNHTIGVEFGSKIINVGGKYVKLQIWDTAGQERFRNFIFGNFD

SEQ ID NO: 804 - protein, 162 aa, Homo sapiens
PGERRRRSQDVADGHVRNLRSVTRSYYRGAAGALLVYDITSRETYNALTNWLTDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 805 - protein, 218 aa, Homo sapiens
MSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITSRETYNALTNWLTDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 806 - protein, 218 aa, Homo sapiens; identical to SEQ ID NO: 805

SEQ ID NO: 807 - protein, 614 aa, Homo sapiens
MSKKNWVTTGTWRQSGNERKSVRKSSVAELGAHHGNCWAMEYRCGSSGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEPPGGTKSTVIEGLHLTGKSRKEVNDSRCSELELILGDDSVMGTFYRQAEPLNQCLT

SEQ ID NO: 808 - protein, 581 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEIPLSMNVSTFLAYDQPTISYCGVHHELLSHKSFETNAQEDTMETHLETELDLSTITTAGRISDHKQQLA

SEQ ID NO: 809 - protein, 513 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEV

SEQ ID NO: 810 - protein, 416 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVETMTLDLALLRSVQHFAEAFKAKNVPLHVLVCNAATFALPWSLTKDGLETTFQVNHLGHFYLVQLLQDVLCRSAPARVIVVSSESHRWRFTDINDSLGKLDFSRLSPTKNDYWAMLAYNRSKLCNILFSNELHRRLSPRGVTSNAVHPGNMMYSNIHRSWWVYTLLFTLARPFTKSMQQGAATTVYCAAVPELEGLGGMYFNNCCRCMPSPEAQSEETARTLWALSERLIQERLGSQSG

SEQ ID NO: 811 - protein, 1173 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 812 - protein, 1115 aa, Homo sapiens
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 813 - protein, 1173 aa, Homo sapiens; identical to SEQ ID NO: 811

SEQ ID NO: 814 - protein, 1216 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 815 - protein, 193 aa, Homo sapiens
MAGAQPGVHALQLKPVCVSDSLKKGTKFVKWDDKSWTMEEQEYGRHEGNVEGELPALKHDAECKTVSTERPDLYYLCREDSTIVTPIILRTDPQGFFFYWTDQNKLFCQPLLETEGLPGQWALGFEKSLRHRCSWKLSVGIHENTWAPPAATTLVALISEDIGVAQMPLWELKGEASPAEDKPVKNQVLNDVI

SEQ ID NO: 816 - protein, 1216 aa, Homo sapiens; identical to SEQ ID NO: 814

SEQ ID NO: 817 - protein, 931 aa, Homo sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 818 - protein, 564 aa, Homo sapiens
MQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 819 - protein, 452 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREASCFVVCILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQKKELPETCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYGPFYANILRKLLFNEEAMGKHILSTVVQY

SEQ ID NO: 820 - protein, 519 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQKKELPETLMTDGARLQELTEKLNQLKIIACLSLITNNMVGAITGGLPELASRLTRISAVLLEGMNKETFNLKEVLNSIGIQTCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYGPFYANILRKLLFNEEAMGKVDASPPTN

SEQ ID NO: 821 - protein, 63 aa, Homo sapiens
MMAQKSKFRVLFMSDPHGTAMPLTSAILESSRASLAAKQEDKCFTDIRNLKWKHFLEHTKQPP

SEQ ID NO: 822 - protein, 69 aa, Homo sapiens [sequence omitted]

SEQ ID NO: 823 - protein, 559 aa, Homo sapiens
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 824 - protein, 103 aa, Homo sapiens [sequence omitted]

SEQ ID NO: 825 - protein, 134 aa, Homo sapiens
MVCLKLPGGSCMAALTVTLMVLSSPLALAGDTQRKCTLWVLSYYGVGKKGSFVNIVPRPCPLRKCDIFFRDCPSLLYGSQIISTTNGTWLLALFMRLCKGPLYRPFFFFKSPPIKPLYHMSSGSLEDLEIRMLK

SEQ ID NO: 826 - protein, 47 aa, Homo sapiens
MSPAGTMTRNVVRQEFEAPGKPQDSSQQDACLILVKGNWTTNEMEVK

SEQ ID NO: 827 - protein, 41 aa, Homo sapiens
MTRNVVRQEFEAPGKPQDSSQQDACLILVKGNWTTNEMEVK

SEQ ID NO: 828 - protein, 89 aa, Homo sapiens
MKPWILLLVMFISGVVMLLPVLGSFWNKDPFLDMIRETEQCWVQPPYKYCEKRCTKIMTCVRPNHTCCWTYCGNICLDNEEPLKSMLNP

SEQ ID NO: 829 - protein, 130 aa, Homo sapiens
MNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 830 - protein, 1009 aa, Homo sapiens
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 831 - protein, 677 aa, Homo sapiens
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRLMSGRDLPCLR

SEQ ID NO: 832 - protein, 755 aa, Homo sapiens
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKDPGAAGHRGPGCAEAEVVAAHGPL

SEQ ID NO: 833 - protein, 236 aa, Homo sapiens
MSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGFELLEELPTPKFSFGGRSGNSVAALVFQKM

SEQ ID NO: 834 - protein, 422 aa, Homo sapiens
MVMVLSESLSTRGADSIACGTFSRELHTPKKMSQGPTLFSCGIMENDRWRDLDRKCPLQIDQPSTSIWECLPEKDSSLWHREAVTACAVTSLIKDLSISDHNGNPSAPPSKRQCRSLSFSDEMSSCRTSWRPLGSKVWTPVEKRRCYSGGSVQRYSNGFSTMQRSSSFSLPSRANVLSSPCDQAGLHHRFGGQPCQGVPGSAPCGQAGDTWSPDLHPVGGGRLDLQRSLSCSHEQFSFVEYCPPSANSTPASTPELARRSSGLSRSRSQPCVLNDKKVGVKRRRPEEVQEQRPSLDLAKMAQNCQTFSSLSCLSAGTEDCGPQSPFARHVSNTRAWTALLSASGPGGRTPAGTPVPEPLPPSFDDHLACQEDLSCEESDSCALDEDCGRRAEPAAAWRDRGAPGNSLCSLDGELDIEQIEKN

SEQ ID NO: 835 - protein, 422 aa, Homo sapiens; identical to SEQ ID NO: 834

SEQ ID NO: 836 - protein, 422 aa, Homo sapiens; identical to SEQ ID NO: 834

SEQ ID NO: 837 - protein, 422 aa, Homo sapiens; identical to SEQ ID NO: 834

SEQ ID NO: 838 - protein, 422 aa, Homo sapiens; identical to SEQ ID NO: 834

SEQ ID NO: 839 - protein, 62 aa, Homo sapiens [sequence omitted]

SEQ ID NO: 840 - protein, 87 aa, Homo sapiens
MQYYDLAHSSCSNLTDHHASLVLLNLKQFRFLLDFLGFDILESEVLFFRVSVSLHLGLSRDRIQDLHFWQEQHRNDAVTHMHHIRGP

SEQ ID NO: 841 - protein, 87 aa, Homo sapiens; identical to SEQ ID NO: 840

SEQ ID NO: 842 - protein, 80 aa, Homo sapiens
MCIPVLELPNKQCPFHCCPNRLEACSCQHSGRECVLPKSLPPWPMQTFSMAGVREGLPGPMGCPALCTHSSRLQEWNPNT

SEQ ID NO: 843 - protein, 65 aa, Homo sapiens
MESCGIYKTTFKSIVKCDVDIHKDLYANTVLSGSTTMYPGIALQDAEGDHCPGSQHEEDQDHCSF

SEQ ID NO: 844 - protein, 343 aa, Homo sapiens
MKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 845 - protein, 580 aa, Homo sapiens
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 846 - protein, 644 aa, Homo sapiens
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 847 - protein, 125 aa, Homo sapiens
MWERGSPTRAGWSISPGSHQDSPLPPRASTSTSRFLPSAERGVTGVGLEQGTFGGRHVLRPGRPGWPQPPCAVRGLWNPRGWSRWTAGVGNPASWVLGLLGLEGPPHCTLATRLWGGCFAHQLSP

SEQ ID NO: 848 - protein, 96 aa, Homo sapiens
MLLSPLLVRLNWPLVATPRPDLAATAPSDSSGSRGHGGASAASRSGAGKGAGEAEAEALESLPRRPAPAQKSARAVHTVGTSTPGTARLRAGAERG

SEQ ID NO: 849 - protein, 242 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEVSILGLSEQNFQKANCQI

SEQ ID NO: 850 - protein, 290 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPELSEKVTEDGTRNPNEKPTQQRSIAFSSNNSVAKPIQKSAKAATEEASSRSPKIDQKKSPYGLWIPI

SEQ ID NO: 851 - protein, 290 aa, Homo sapiens; identical to SEQ ID NO: 850

SEQ ID NO: 852 - protein, 290 aa, Homo sapiens; identical to SEQ ID NO: 850

SEQ ID NO: 853 - protein, 162 aa, Homo sapiens [sequence omitted]

SEQ ID NO: 854 - protein, 1657 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 855 - protein, 1657 aa, Homo sapiens; identical to SEQ ID NO: 854

SEQ ID NO: 856 - protein, 1657 aa, Homo sapiens; identical to SEQ ID NO: 854

SEQ ID NO: 857 - protein, 255 aa, Homo sapiens [sequence omitted]

SEQ ID NO: 858 - protein, 143 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNGEEMLVGRLFQDVMQKKLRAELFTLYTSAVSSP

SEQ ID NO: 859 - protein, 255 aa, Homo sapiens
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVGASRHQGLL

SEQ ID NO: 860 - protein, 2105 aa, Homo sapiens
MMPSACGRPSLSWSVRRRSSNRRPNCCSSSLRRMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 861 - protein, 2524 aa, Homo sapiens [sequence omitted]

SEQ ID NO: 862 - protein, 2105 aa, Homo sapiens; identical to SEQ ID NO: 860

SEQ ID NO: 863 - protein, 183 aa, Homo sapiens
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATGQLHPDPKS

SEQ ID NO: 864 - protein, 4574 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRDDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDLEVERWRERVAQVLERWQAVLAQTDLRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAETEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKANVEEARRLRERAEQESARQLQLAQEAAQKRLQAEEKAHAFAVQQKEQELQQTLQQEQSVLDQLRGEAEAARRAAEEAEEARVQAEREAAQARRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAEGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 865 - protein, 126 aa, Homo sapiens [sequence omitted]

SEQ ID NO: 866 - protein, 350 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 867 - protein, 271 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 868 - protein, 350 aa, Homo sapiens; identical to SEQ ID NO: 866

SEQ ID NO: 869 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 870 - protein, 169 aa, Homo sapiens
MGYVDDTQFVRFDSDSACPRMEPRAPWVEQEGPEYWEEETRNTKAHAQTDRMNLQTLRGYYNQSEAKIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 871 - protein, 206 aa, Homo sapiens
MSWTHTETQGYGMKGKLTLWQQAPWSDFSSRRVHGDRVSLLPLPTCVGSFFLDTHQAAPVLTPIECRVPREANQCSRGPGSKVPTHPPGLRFSPVAEDGVMAPRTLLLLLSGALVLTQTWAGFHSLRYFHTTMSRPGRADPRFLSVGDVDDTQCVRLDSDATSPRMEPEGPEYWEEETGTAKAKAQFYRVNLRTLSGYYNQSEACE

SEQ ID NO: 872 - protein, 243 aa, Homo sapiens
MAPRTLLLLLSGALVLTQTWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRAGPSSQPTFLIMGIVTVLVVLGAVVTAVMWKNKTPGRKGVS

SEQ ID NO: 873 - protein, 338 aa, Homo sapiens; identical to SEQ ID NO: 869

SEQ ID NO: 874 - protein, 343 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 875 - protein, 158 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSS

SEQ ID NO: 876 - protein, 105 aa, Homo sapiens
MGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSS

SEQ ID NO: 877 - protein, 251 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 878 - protein, 198 aa, Homo sapiens
MGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 879 - protein, 465 aa, Homo sapiens
MLLLGLLLLLPLLAGARLLWNWWKLRSLHLPPLAPGFLHLLQPDLPIYLLGLTQKFGPIYRLHLGLQDKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 880 - protein, 495 aa, Homo sapiens
MLLLGLLLLLPLLAGARLLWNWWKLRSLHLPPLAPGFLHLLQPDLPIYLLGLTQKFGPIYRLHLGLQDVVVLNSKRTIEEAMVKKWADFAGRPEPLTYKLVSRNYPDLSLGDYSLLWKAHKKLTRSALLLGIRDSMEPVVEQLTQEFCERMRAQPGTPVAIEEEFSLLTCSIICYLTFGDKIKDDNLMPAYYKCIQEVLKTWSHWSIQIVDVIPFLRFFPNPGLRRLKQAIEKRDHIVEMQLRQHKESLVAGQWRDMMDYMLQGVAQPSMEEGSGQLLEGHVHMAAVDLLIGGTETTANTLSWAVVFLLHHPEIQQRLQEELDHELGPGASSSRVPYKDRARLPLLNATIAEVLRLRPVVPLALPHRTTRPSSISGYDIPEGTVIIPNLQGAHLDETVWERPHEFWPDRFLEPGKNSRALAFGCGARVCLGEPLARLELFVVLTRLLQAFTLLPSGDALPSLQPLPHCSVILKMQPFQVRLQPRGMGAHSPGQSQ

SEQ ID NO: 881 - protein, 302 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 882 - protein, 302 aa, Homo sapiens; identical to SEQ ID NO: 881

SEQ ID NO: 883 - protein, 293 aa, Homo sapiens
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 884 - protein, 307 aa, Homo sapiens
MKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 885 - protein, 302 aa, Homo sapiens; identical to SEQ ID NO: 881

SEQ ID NO: 886 - protein, 308 aa, Homo sapiens
MKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 887 - protein, 309 aa, Homo sapiens [sequence omitted]

SEQ ID NO: 888 - protein, 293 aa, Homo sapiens; identical to SEQ ID NO: 883

SEQ ID NO: 889 - protein, 293 aa, Homo sapiens; identical to SEQ ID NO: 883

SEQ ID NO: 890 - protein, 293 aa, Homo sapiens; identical to SEQ ID NO: 883

SEQ ID NO: 891 - protein, 302 aa, Homo sapiens; identical to SEQ ID NO: 881

SEQ ID NO: 892 - protein, 180 aa, Homo sapiens
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 893 - protein, 180 aa, Homo sapiens; identical to SEQ ID NO: 892

SEQ ID NO: 894 - protein, 61 aa, Homo sapiens [sequence omitted]

SEQ ID NO: 895 - protein, 255 aa, Homo sapiens; identical to SEQ ID NO: 859

SEQ ID NO: 896 - protein, 255 aa, Homo sapiens; identical to SEQ ID NO: 859

SEQ ID NO: 897 - protein, 255 aa, Homo sapiens; identical to SEQ ID NO: 859

SEQ ID NO: 898 - protein, 383 aa, Homo sapiens
MGLGPVFLLLAGIFPFAPPGAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 899 - protein, 332 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 900 - protein, 351 aa, Homo sapiens
MVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 901 - protein, 332 aa, Homo sapiens; identical to SEQ ID NO: 899

SEQ ID NO: 902 - protein, 314 aa, Homo sapiens [sequence omitted]

SEQ ID NO: 903 - protein, 332 aa, Homo sapiens; identical to SEQ ID NO: 899

SEQ ID NO: 904 - protein, 170 aa, Homo sapiens
MNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 905 - protein, 344 aa, Homo sapiens
MFVFLFLAYFTYNIFEVRWAQWLTPGFPALWEAEAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 906 - protein, 383 aa, Homo sapiens; identical to SEQ ID NO: 898

SEQ ID NO: 907 - protein, 383 aa, Homo sapiens
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 908 - protein, 283 aa, Homo sapiens
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 909 - protein, 225 aa, Homo sapiens
MPGTQTPAPAEDPHSGCRDPVPARPQACHPKSQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 910 - protein, 854 aa, Homo sapiens [sequence omitted]

SEQ ID NO: 911 - protein, 2003 aa, Homo sapiens [sequence omitted]

SEQ ID NO: 912 - protein, 344 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRPSGRLTYLIRSSS

SEQ ID NO: 913 - protein, 283 aa, Homo sapiens; identical to SEQ ID NO: 908

SEQ ID NO: 914 - protein, 256 aa, Homo sapiens
APPLPALPPPAPPAPPPRRCLHLSISALLPLRHPAPRLQHRPRTPTPAAGTLSQRDRRHVIRKVRTPRLSPSHFSPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 915 - protein, 287 aa, Homo sapiens
MVARMDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 916 - protein, 430 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 917 - protein, 349 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGGSHCHPG

SEQ ID NO: 918 - protein, 430 aa, Homo sapiens; identical to SEQ ID NO: 916

SEQ ID NO: 919 - protein, 283 aa, Homo sapiens; identical to SEQ ID NO: 908

SEQ ID NO: 920 - protein, 435 aa, Homo sapiens
MGAGERVQAPPRAEATAGRGADRARTLEGSRMAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 921 - protein, 370 aa, Homo sapiens
MTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 922 - protein, 435 aa, Homo sapiens; identical to SEQ ID NO: 920

SEQ ID NO: 923 - protein, 373 aa, Homo sapiens
MGAGERVQAPPRAEATAGRGADRARTLEGSRMAAGTAVGAWVLVLSLWGAVVGAQNITARIGEPLVLKCKGAPKKPPQRLEWKLGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 924 - protein, 160 aa, Homo sapiens
MEAERPQEEEDGEQGPPQDEEGWPPPNSTTRPWRSAPPSPPPPGTRHTALGPRSASLLSLQTELLLDLVAEAQSRRLEEQRATFYTPQNPSSLAPAPLRPLEDREQLYSTILSHQCQRMEAQRSEPPLPPGGQELLELLLRVQGGGRMEEQRSRPPTHTC

SEQ ID NO: 925 - protein, 225 aa, Homo sapiens; identical to SEQ ID NO: 909

SEQ ID NO: 926 - protein, 113 aa, Homo sapiens [sequence omitted]

SEQ ID NO: 927 - protein, 1080 aa, Homo sapiens [sequence omitted]

SEQ ID NO: 928 - protein, 113 aa, Homo sapiens
MEAERPQEEEDGEQTELLLDLVAEAQSRRLEEQRATFYTPQNPSSLAPAPLRPLEDREQLYSTILSHQCQRMEAQRSEPPLPPGGQELLELLLRVQGGGRMEEQRSRPPTHTC

SEQ ID NO: 929 - protein, 370 aa, Homo sapiens; identical to SEQ ID NO: 921

SEQ ID NO: 930 - protein, 283 aa, Homo sapiens; identical to SEQ ID NO: 908

SEQ ID NO: 931 - protein, 306 aa, Homo sapiens
MSSEKSGLPDSVPHTSPPPYNAPQPPAEPPAPPPQAAPSSHHHHHHHYHQSGTATLPRLGAGGLASSAATAQRGPSSSATLPRPPHHAPPGPAAGAPPPGCATLPRMPPDPYLQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 932 - protein, 2003 aa, Homo sapiens [sequence omitted]

SEQ ID NO: 933 - protein, 160 aa, Homo sapiens; identical to SEQ ID NO: 924

SEQ ID NO: 934 - protein, 1080 aa, Homo sapiens [sequence omitted]

SEQ ID NO: 935 - protein, 430 aa, Homo sapiens; identical to SEQ ID NO: 916

SEQ ID NO: 936 - protein, 306 aa, Homo sapiens; identical to SEQ ID NO: 931

SEQ ID NO: 937 - protein, 430 aa, Homo sapiens; identical to SEQ ID NO: 916

SEQ ID NO: 938 - protein, 306 aa, Homo sapiens; identical to SEQ ID NO: 931

SEQ ID NO: 939 - protein, 1557 aa, Homo sapiens [sequence omitted]

SEQ ID NO: 940 - protein, 3451 aa, Homo sapiens [sequence omitted]

SEQ ID NO: 941 - protein, 497 aa, Homo sapiens
MGCEDPTRPTASREPPAPSAQFWRAPVTSNSVKSGRPQPRSTGCPHHPGRTASKSPTSWRTEGSLRVCRWMARPGPRNSRWEPRKRHGWELRENEEVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 942 - protein, 4040 aa, Homo sapiens [sequence omitted]

SEQ ID NO: 943 - protein, 4289 aa, Homo sapiens [sequence omitted]

SEQ ID NO: 944 - protein, 673 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 945 - protein, 2437 aa, Homo sapiens [sequence omitted]

SEQ ID NO: 946 - protein, 409 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQVPRPH

SEQ ID NO: 947 - protein, 1174 aa, Homo sapiens [sequence omitted]

SEQ ID NO: 948 - protein, 837 aa, Homo sapiens
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKYRGLTAPDAEMLYMQEVERMDGYGEESYPAKDSQGSDISIGACLEGIFVKHKNGRHPVVFRWHDIANMSHNKSFFALELANKEETIQFQTEDMETAKYIWRLCVARHKFYRLNQCNLQTQTVTVNPIRRRSSSRMSLPKPQPYVMPPPPQLHYNGHYTEPYASSQDNLFVPNQNGYYCHSQTSLDRAQIDLNGRIRNGSVYSAHSTNSLNNPQPYLQPSPMSSNPSITGSDVMRPDYLPSHRHSAVIPPSYRPTPDYETVMKQLNRGLVHAERQSHSLRNLNIGSSYAYSRPAALVYSQPEIREHAQLPSPAAAHCPFSLSYSFHSPSPYPYPAERRPVVGAVSVPELTNAQLQAQDYPSPNIMRTQVYRPPPPYPPPRPANSTPDLSRHLYISSSNPDLITRRVHHSVQTFQEDSLPVAHSLQEVSEPLTAARHAQLHKRNSIEVAGLSHGLEGLRLKERTLSASAAEVAPRAVSVGSQPSVFTERTQREGPEEAEGLRYGHKKSLSDATMLIHSSEEEEDEDFEEESGARAPPARAREPRPGLAQDPPGCPRVLLAGPLHILEPKAHVPDAEKRMMDSSPVRTTAEAQRPWRDGLLMPSMSESDLTTSGRYRARRDSLKKRPVSDLLSGKKNIVEGLPPLG

SEQ ID NO: 949 - protein, 837 aa, Homo sapiens; identical to SEQ ID NO: 948

SEQ ID NO: 950 - protein, 103 aa, Homo sapiens
MPPPMPQPVPQELVWQQLGWQQLVSQQLGWQQLELQVPLVEKLGNPQKLVWQQLGWQQLVSQQLGWQQLEPHVPLVEQLGYPQKLVWQQVMVLGAGMKSGLLG

SEQ ID NO: 951 - protein, 362 aa, Homo sapiens [sequence omitted]

SEQ ID NO: 952 - protein, 362 aa, Homo sapiens [sequence omitted]

SEQ ID NO: 953 - protein, 331 aa, Homo sapiens
MLVMAPRTVLLLLSAALALTETWAGSHSMRYFYTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQERAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWAVFPVHRPHRGHCCWPGCPSSCGHRSCGRCCDV

SEQ ID NO: 954 - protein, 362 aa, Homo sapiens [sequence omitted]

SEQ ID NO: 955 - protein, 366 aa, Homo sapiens [sequence omitted]

SEQ ID NO: 956 - protein, 703 aa, Homo sapiens [sequence omitted]

SEQ ID NO: 957 - protein, 362 aa, Homo sapiens [sequence omitted]

SEQ ID NO: 958 - protein, 366 aa, Homo sapiens [sequence omitted]

SEQ ID NO: 959 - protein, 366 aa, Homo sapiens
MRVMAPRTLILLLSGALALTETWAGSHSMRYFSTSVSWPGRGEPRFIAVGYVDDTQFVRFDSDAASPRGEPREPWVEQEGPEYWDRETQKYKRQAQADRVNLRKLRGYYNQSEDGSHTLQRMFGCDLGPDGRLLRGYNQFAYDGKDYIALNEDLRSWTAADTAAQITQRKWEAAREAEQRRAYLEGTCVEWLRRYLENGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWKPSSQPTIPIVGIVAGLAVLAVLAVLGAMVAVVMCRRKSSGGKGGSCSQAASSNSAQGSDESLIACKA

SEQ ID NO: 960 - protein, 6670 aa, Homo sapiens [sequence omitted]

SEQ ID NO: 961 - protein, 1321 aa, Homo sapiens [sequence omitted]

SEQ ID NO: 962 - protein, 6700 aa, Homo sapiens [sequence omitted]

SEQ ID NO: 963 - protein, 6391 aa, Homo sapiens [sequence omitted]

SEQ ID NO: 964 - protein, 6718 aa, Homo sapiens [sequence omitted]

SEQ ID NO: 965 - protein, 2999 aa, Homo sapiens [sequence omitted]

SEQ ID NO: 966 - protein, 6669 aa, Homo sapiens [sequence omitted]

SEQ ID NO: 967 - protein, 6762 aa, Homo sapiens [sequence omitted]

SEQ ID NO: 968 - protein, 163 aa, Homo sapiens
MAAPCLLRQGRAGALKTMLQEAQVFRGLASTVSLSAESGKSEKGQPQNSKKQSPPKNVVEPKERGKLLATQTAAELSKNLSSPSSYPPALEAEGEAMEDAAAPGDDRGGTQEPAPVPAEPFDNTTYKNLQHHDYSTYTFLDLNLELSKFRMPQPSSGRESPRH

SEQ ID NO: 969 - protein, 473 aa, Homo sapiens
MAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGDDRGGTQEPAPVPAEPFDNTTYKNLQHHDYSTYTFLDLNLELSKFRMPQPSSGRESPRH

SEQ ID NO: 970 - protein, 456 aa, Homo sapiens
MLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGDDRGGTQEPAPVPAEPFDNTTYKNLQHHDYSTYTFLDLNLELSKFRMPQPSSGRESPRH

SEQ ID NO: 971 - protein, 1218 aa, Homo sapiens [sequence omitted]

SEQ ID NO: 972 - protein, 1211 aa, Homo sapiens [sequence omitted]

SEQ ID NO: 973 - protein, 1211 aa, Homo sapiens [sequence omitted]

SEQ ID NO: 974 - protein, 250 aa, Homo sapiens
MTRGGGGCLLGGGDPALPGSKPLLPFQISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 975 - protein, 375 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 976 - protein, 375 aa, Homo sapiens; identical to SEQ ID NO: 975

SEQ ID NO: 977 - protein, 375 aa, Homo sapiens; identical to SEQ ID NO: 975

SEQ ID NO: 978 - protein, 314 aa, Homo sapiens [sequence omitted]

SEQ ID NO: 979 - protein, 375 aa, Homo sapiens; identical to SEQ ID NO: 975

SEQ ID NO: 980 - protein, 375 aa, Homo sapiens; identical to SEQ ID NO: 975

SEQ ID NO: 981 - protein, 295 aa, Homo sapiens
MRHSVARPTRLPRRLSPFWDPATCKNLEGGAGEVVRGRDPRRLRTSRSTEILGEDLAGPSAGAAARPAAPPPQPREPGAPGLRRAPPRTRMDSSGLGPCSEAPLHTSAGLSGRNLRAAGGVLPVDLERERAALCARQSGHGPPAVRWLLGSRGAESGGLARRRVAAEHAQPSANLVCRSALETSAFPPSKPKSPRGRVRARSSDGRLRHPAWRAGSGGRGGRGPSAELASRYWGRRRALPGAADLRPKGARADDRRPLRAGRKLHLPEAARLPGNVGKSGEPHKAGEVGNHPRDS

SEQ ID NO: 982 - protein, 2101 aa, Homo sapiens
MATLPSAERRAFALKINRYSSVEIRKQFTLPPNLGQYHRQSISTSGFPSLQLPQFYDPVEPVDFEGLLMTHLNSLDVQLAQELGDFTDDDLDVVFTTKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRTLCCLSAYVYQLQNIFNFDFF

SEQ ID NO: 983 - protein, 103 aa, Homo sapiens
MRKFPAPTDRRGLRLAGHVPRLLCGAPGPRFPHPATLEATEPPAGHGHSAERRAPRVRAQDQQVRRPPRRAGCGRTAQRWCEAELRCRGRGRTSPFASAAGRA

SEQ ID NO: 984 - protein, 1701 aa, Homo sapiens
MPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 985 - protein, 2010 aa, Homo sapiens
MTHLNSLDVQLAQELGDFTDDDLDVVFTTKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 986 - protein, 145 aa, Homo sapiens
MNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 987 - protein, 94 aa, Homo sapiens [sequence omitted]

SEQ ID NO: 988 - protein, 201 aa, Homo sapiens
  VARIANT (1)...(201): Xaa = Any Amino Acid
MCAARLAAAAAQSVYAFSARPLAGGEPVSLGSLRGKVLLIENVASLXGTTVRDYTQMNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 989 - protein, 1109 aa, Homo sapiens
MHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 990 - protein, 632 aa, Homo sapiens
MRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 991 - protein, 1111 aa, Homo sapiens
MHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 992 - protein, 663 aa, Homo sapiens
MRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 993 - protein, 855 aa, Homo sapiens [sequence omitted]

SEQ ID NO: 994 - protein, 237 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 995 - protein, 237 aa, Homo sapiens; identical to SEQ ID NO: 994

SEQ ID NO: 996 - protein, 237 aa, Homo sapiens; identical to SEQ ID NO: 994

SEQ ID NO: 997 - protein, 113 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTDFITVFRKLMMILAMNEK

SEQ ID NO: 998 - protein, 237 aa, Homo sapiens; identical to SEQ ID NO: 994

SEQ ID NO: 999 - protein, 237 aa, Homo sapiens; identical to SEQ ID NO: 994

SEQ ID NO: 1000 - protein, 237 aa, Homo sapiens; identical to SEQ ID NO: 994

SEQ ID NO: 1001 - protein, 237 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWPFQANLYVGLVVMCGFVLVDTQLIIEKAEHGDQDYIWHCIDLFLDFITVFRKLMMILAMNEKDKKKEKK

SEQ ID NO: 1002 - protein, 888 aa, Homo sapiens
MAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISIPVRPEDLWSAEERGASASNPDCQLPHLFCYPAQSNFSGVRYPLSWIEEVKSGRLRPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYMALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCNLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVNFGMYLMHASLDLSSPCFLSVGSQVLPVLKENVEGHDLPASEKHQDVTS

SEQ ID NO: 1003 - protein, 765 aa, Homo sapiens
MNVALQELGAGSNMVEYKRATLRDEDAPETPVEGGASPDAMEVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 1004 - protein, 737 aa, Homo sapiens [sequence omitted]

SEQ ID NO: 1005 - protein, 766 aa, Homo sapiens [sequence omitted]

SEQ ID NO: 1006 - protein, 133 aa, Homo sapiens
GASGVTGAELRVPRSRVLGSALPRRSRFCPLRLVRGLLLLPCPPRAGAAARGPYPCARWVIPARPRQVELAGPAPHGLGLVRFPPACLSLLEDACVGTRDPAPSESRLYLVKANRSKRLLVPGPSGERQSLRV

SEQ ID NO: 1007 - protein, 255 aa, Homo sapiens [sequence omitted]

SEQ ID NO: 1008 - protein, 788 aa, Homo sapiens [sequence omitted]

SEQ ID NO: 1009 - protein, 1421 aa, Homo sapiens
MPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNAAGSECEDVDECENHLACPGQECVNSPGSFQCRACPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 1010 - protein, 1417 aa, Homo sapiens
  VARIANT (1)...(1417): Xaa = Any Amino Acid
MPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNAAGSECEDVDECENHLACPGQECVNSPGSFQCRACPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHSLAPAGRPPAPATRGPCRASCSPLMRMCTGPPAWTWRRDLRTPGSCDALHCSRLHQRLPLMSWSRAWPRGPFTCPLPFIKFSIKNHLFSX

SEQ ID NO: 1011 - protein, 1557 aa, Homo sapiens [sequence omitted]

SEQ ID NO: 1012 - protein, 1664 aa, Homo sapiens
  VARIANT (1)...(1664): Xaa = Any Amino Acid
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAIPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNAAGSECEDVDECENHLACPGQECVNSPGSFQCRACPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHSLAPAGRPPAPATRGPCRASCSPLMRMCTGPPAWTWRRDLRTPGSCDALHCSRLHQRLPLMSWSRAWPRGPFTCPLPFIKFSIKNHLFSX

SEQ ID NO: 1013 - protein, 1587 aa, Homo sapiens [sequence omitted]

SEQ ID NO: 1014 - protein, 1557 aa, Homo sapiens [sequence omitted]

SEQ ID NO: 1015 - protein, 1587 aa, Homo sapiens
MGDVKALLFVVAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCFCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGGCKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSVGMSPGSQPQAPVSPVLPARPPPPPLSRRPRKPRKGPVGSGCRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNDRCVRVPEGFTCRCFDGYRLDMTRMACVDINECDEAEAASPLCVNARCLNTDGSFRCICRPGFAPTHQPHHCAPARPRA

SEQ ID NO: 1016 - protein, 194 aa, Homo sapiens
MGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGDGQWLACGLANHLLLVFDASLTGTPAVFSGHDGAVNAVCWSQDRRWLLSAARDGTLRMWSARGAELALLLI

SEQ ID NO: 1017 - protein, 265 aa, Homo sapiens
RQLSSEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRAARNVMKDQRLVFHSKVRSSGYASAPHVTMFSPKTNIKSEGKGSSRSRSSCAREAYPVECAVPTKPGPQVAAAPTCTRVCCIQYSGAPRPAGAG

SEQ ID NO: 1018 - protein, 194 aa, Homo sapiens; identical to SEQ ID NO: 1016

SEQ ID NO: 1019 - protein, 194 aa, Homo sapiens; identical to SEQ ID NO: 1016

SEQ ID NO: 1020 - protein, 240 aa, Homo sapiens
RQLSSEESQLPSTSALGKGEQVEVTFPVLRLAPCDLSLIPNSACGCLSSENTRCVWIGSSVGLFVFNLANLEVEAALYYKDFQSLSILLAGSCALRNRTADQKVLCLLASLFGGKIAVLEINPAALVRAQQCPSMGQSLSVPASSCVLPTSPLYLGIAKEKSTKAASEQRRGHVTMFSPKTNIKSEGKGSSRSRSSCAREAYPVECAVPTKPGPQVAAAPTCTRVCCIQYSGAPRPAGAG

SEQ ID NO: 1021 - protein, 429 aa, Homo sapiens [sequence omitted]

SEQ ID NO: 1022 - protein, 462 aa, Homo sapiens
MAATVNLELDPIFLKALGFLHSKSKDSAEKLKALLDESLARGIDSSYRPSQKDVEPPKISSTKNISIKQEPKISSSLPSGNNNGKVLTTEKVKKEAEKRPADKMKSDITEGVDIPKKPRLEKPETQSSPITVQSSKDLPMADLSSFEETSADDFAMEMGLACVVCRQMMVASGNQLVECQECHNLYHRDCHKPQVTDKEANDPRLVWYCARCTRQMKRMAQKTQKPPQKPAPAVVSVTPAVKDPLVKKPETKLKQETTFLAFKRTEVKTSTVISGNSSSASVSSSVTSGLTGWAAFAAKTSSAGPSTAKLSSTTQNNTGKPATSSANQKPVGLTGLATSSKGGIGSKIGSNNSTTPTVPLKPPPPLTLGKTGLSRSVSCDNVSKVGLPSPSSLVPGSSSQLSGNGNSGTSGPSGSTTSKTTSESSSSPSASLKGPTSQESQLNAMKRLQMVKKKAAQKKLKK

SEQ ID NO: 1023 - protein, 462 aa, Homo sapiens; identical to SEQ ID NO: 1022

SEQ ID NO: 1024 - protein, 578 aa, Homo sapiens
MSHQFSSQSAFSSMSRRVYSTSSSAGSGGGSPAVGSVCYARGRCGGGGYGIHGRGFGSRSLYNLGGSRSISINLMGRSTSGFCQGGGVGGFGGGRGFGVGSTGAGGFGGGGFGGAGFGTSNFGLGGFGPYCPPGGIQEVTINQSLLEPLHLEVDPEIQRIKTQEREQIMVLNNKFASFIDKVRFLEQQNQVLQTKWELLQQVNTSTGTNNLEPLLENYICDLRRQVDLLSAEQMRQNAEVRSMQDVVEDYKSKYEDEINKRTGSENDFVVLKKDVDAAYVSKVDLESRVDTLTGEVNFLKYLFLTELSQVQTHISDTNVILSMDNNRSLDLDSIIDAVRTQYELIAQRSKDEAEALYQTKYQELQIMAGRHGDDLKNSKMEIAELNRTVQRLQAEISNVKKQIEQMQSLISDAEERGEQALQDAWQKLQDLEEALQQSKEELARLLRDYQAMLGVKLSLDVEIATYRQLLEGEESRMSGELQSHVSISVQNSQVSVNGGAGGGGSYGSGGYGGGSGGGYGGGRSYRGGGARGGSGGGYGSGCGGGGGSYGGSGRSGRGSSRVQIIQTSTNTSHRRILE

SEQ ID NO: 1025 - protein, 371 aa, Homo sapiens
QTLLLVHTMFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTTVFLAEYTGPLLIYLLFYLRIPCIYDGKESARRLRHPVVHLACFCHCIHYIRYLLETLFVHKVSAGHTPLKNLIMSCAFYWGFTSWIAYYINHPLYTPPSFGNRQITVSAINFLICEAGNHFINVMLSHPNHTGNNACFPSPNYNPFTWMFFLVSCPNYTYEIGSWISFTVMTQTLPVGIFTLLMSIQMSLWAQKKHKIYLRKFNSYIHRKSAMIPFIL

SEQ ID NO: 1026 - protein, 255 aa, Homo sapiens
RLSKCSLSAACLDHQSVLTGQCHWRRRRDMSRAQIWALVSGVGGFGALVAATTSNEWKVTTRASSVITATWVYQGLWMNCAGNALGSFHCRPHFTIFKVAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 1027 - protein, 228 aa, Homo sapiens
MASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 1028 - protein, 37 aa, Homo sapiens
MQRNKEITKLFFFETVLLRRPGWHAPWQQSETPSQKG

SEQ ID NO: 1029 - protein, 104 aa, Homo sapiens
MIRFAMCSIIDILLSFEKGNNACFPSPNYNPFTWMFFLVSCPNYTYEIGSWISFTVMTQTLPVGIFTLLMSIQMSLWAQKKHKIYLRKFNSYIHRKSAMIPFIL

SEQ ID NO: 1030 - protein, 89 aa, Homo sapiens
QKFFRDKISCLLPKWECSGAIITHCSLKLLGSINHPALASLVAGTVGPHLDNFLFFVEMRSYYVAQAGLKLLASSNPPAWPPKVLGLQA

SEQ ID NO: 1031 - protein, 357 aa, Homo sapiens [sequence omitted]

SEQ ID NO: 1032 - protein, 152 aa, Homo sapiens; identical to SEQ ID NO: 733
  VARIANT (1)...(152): Xaa = Any Amino Acid

SEQ ID NO: 1033 - protein, 732 aa, Homo sapiens [sequence omitted]

SEQ ID NO: 1034 - protein, 619 aa, Homo sapiens [sequence omitted]

SEQ ID NO: 1035 - protein, 720 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 1036 - protein, 720 aa, Homo sapiens; identical to SEQ ID NO: 1035

SEQ ID NO: 1037 - protein, 720 aa, Homo sapiens; identical to SEQ ID NO: 1035

SEQ ID NO: 1038 - protein, 720 aa, Homo sapiens; identical to SEQ ID NO: 1035

SEQ ID NO: 1039 - protein, 450 aa, Homo sapiens
MDGSRRVRATSVLPRYGPPCLFKGHLSTKSNAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSAGDHDLRQNHHASPSYPSTAVDQQRRVGALGITCAICMASNRLDLFKICCGKSMK

SEQ ID NO: 1040 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVTSKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 1041 - protein, 414 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGFDSCGGENPLPV

SEQ ID NO: 1042 - protein, 408 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 1043 - protein, 400 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 1044 - protein, 400 aa, Homo sapiens; identical to SEQ ID NO: 1043

SEQ ID NO: 1045 - protein, 400 aa, Homo sapiens; identical to SEQ ID NO: 1043

SEQ ID NO: 1046 - protein, 665 aa, Homo sapiens
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 1047 - protein, 670 aa, Homo sapiens
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 1048 - protein, 955 aa, Homo sapiens
MGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 1049 - protein, 406 aa, Homo sapiens
MPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 1050 - protein, 594 aa, Homo sapiens
MALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 1051 - protein, 215 aa, Homo sapiens
MEKNPPDDTGPVHVPLGHIVANEKWRGSQLAQEMQGKIKLIFEDGLTPDFYLSNRCCILYVTEADLVAGNGYRKRLVRVRNSNNLKGIVVVEKTRMSEQYFPALQKFTVLDLGMVLLPVASQMEASCLVIQLVQEQTKEPSKNPLLGKKRALLLSEPSLLRTVQQIPGVGKVKAPLLLQKFPSIQQLSNASIGELEQVVGQAVAQQIHAFFTQPR

SEQ ID NO: 1052 - protein, 206 aa, Homo sapiens
MLTIFNEIDVSNIQKMRARHKEAFLKKHNLKLGFMSASVKASAFALQEQPVVNAVIDDITKEVVYRDYIDISVAVATPQGLVVPVIRNVEAMNYADIEQTITELGEKARKNEFAIEDMDGGTFTISNGGVFGSLFEHPLSTPLSAILGMHGIFDKPVAIGGKVEVQPMMYVALTYDHRLIDGREAVTFLRKIKAAVEDPRVLLFDL

SEQ ID NO: 1053 - protein, 266 aa, Homo sapiens
MTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 1054 - protein, 380 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 1055 - protein, 380 aa, Homo sapiens; identical to SEQ ID NO: 1054

SEQ ID NO: 1056 - protein, 267 aa, Homo sapiens [sequence omitted]

SEQ ID NO: 1057 - protein, 425 aa, Homo sapiens [sequence omitted]

SEQ ID NO: 1058 - protein, 267 aa, Homo sapiens [sequence omitted]

SEQ ID NO: 1059 - protein, 267 aa, Homo sapiens [sequence omitted]

SEQ ID NO: 1060 - protein, 425 aa, Homo sapiens [sequence omitted]

SEQ ID NO: 1061 - protein, 425 aa, Homo sapiens [sequence omitted]

SEQ ID NO: 1062 - protein, 267 aa, Homo sapiens [sequence omitted]

SEQ ID NO: 1063 - protein, 425 aa, Homo sapiens
MASGQFVNKLQEEVICPICLDILQKPVTIDCGHNFCLKCITQIGETSCGFFKCPLCKTSVRRDAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 1064 - protein, 1144 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 1065 - protein, 1144 aa, Homo sapiens; identical to SEQ ID NO: 1064

SEQ ID NO: 1066 - protein, 1096 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSVSAHPTLHSGHEAGPFHITSYNRLQRPEKLASFSQISPFRNTWTSAATWNCWAGEGEVRWEPGKSPTGSQDKDKDWPSNISRPLCPGTVSSNSEPVSIDWVTCIPGRMLLHTRGAPLGDCRFYVSVEVVETGPES

SEQ ID NO: 1067 - protein, 1108 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQWRLAEKLHERGKGTEEQAVAVSRW

SEQ ID NO: 1068 - protein, 425 aa, Homo sapiens
MAAGFGRCCRCSLQVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 1069 - protein, 421 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 1070 - protein, 2244 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1071 - protein, 2205 aa, Homo sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1072 - protein, 2210 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1073 - protein, 2411 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1074 - protein, 3177 aa, Homo sapiens [sequence omitted]

SEQ ID NO: 1075 - protein, 2971 aa, Homo sapiens [sequence omitted]

SEQ ID NO: 1076 - protein, 2977 aa, Homo sapiens [sequence omitted]

SEQ ID NO: 1077 - protein, 2211 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1078 - protein, 317 aa, Homo sapiens [sequence omitted]

SEQ ID NO: 1079 - protein, 317 aa, Homo sapiens [sequence omitted]

SEQ ID NO: 1080 - protein, 359 aa, Homo sapiens [sequence omitted]

SEQ ID NO: 1081 - protein, 247 aa, Homo sapiens [sequence omitted]

SEQ ID NO: 1082 - protein, 359 aa, Homo sapiens
MLSLNNLQNIIYNPVIPYVGTIPDQLDPGTLIVICGHVPSDADRFQVDLQNGSSVKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLQTVSPSWDLQGHGSETFCSVLWTRVFLEIAFCRPIGLTVASFQSLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 1083 - protein, 1927 aa, Homo sapiens [sequence omitted]

SEQ ID NO: 1084 - protein, 894 aa, Homo sapiens
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGPLRGKGPIDLITVGSLIELQDSQNPFQYWIVSVIENVGGRLRLRYVGLEDTESYDQWLFYLDYRLRPVGWCQENKYRMDPPSEIYPLKMASEWKCTLEKSLIDAAKFPLPMEVFKDHADLRSHFFTVGMKLETVNMCEPFYISPASVTKVFNNHFFQVTIDDLRPEPSKLSMLCHADSLGILPVQWCLKNGVSLTPPKGYSGQDFDWADYHKQHGAQEAPPFCFRNTSFSRGFTKNMKLEAVNPRNPGELCVASVVSVKGRLMWLHLEGLQTPVPEVIVDVESMDIFPVGWCEANSYPLTAPHKTVSQKKRKIAVVQPEKQLPPTVPVKKIPHDLCLFPHLDTTGTVNGKYCCPQLFINHRCFSGPYLNKGRIAELPQSVGPGKCVLVLKEVLSMIINAAYKPGRVLRELQLVEDPHWNFQEETLKAKYRGKTYRAVVKIVRTSDQVANFCRRVCAKLECCPNLFSPVLISENCPENCSIHTKTKYTYYYGKRKKISKPPIGESNPDSGHPKPARRRKRRKSIFVQKKRRSSAVDFTAGSGEESEEEDADAMDDDTASEETGSELRDDQTDTSSAEVPSARPRRAVTLRSGSEPVRRPPPERTRRGRGAPAASSAEEGEKCPPTKPEGTEDTKQEEEERLVLESNPLEWTVTDVVRFIKLTDCAPLAKIFQEQDIDGQALLLLTLPTVQECMELKLGPAIKLCHQIERVKVAFYAQYAN

SEQ ID NO: 1085 - protein, 288 aa, Homo sapiens
MDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1086 - protein, 226 aa, Homo sapiens
MEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1087 - protein, 288 aa, Homo sapiens; identical to SEQ ID NO: 1085

SEQ ID NO: 1088 - protein, 288 aa, Homo sapiens; identical to SEQ ID NO: 1085

SEQ ID NO: 1089 - protein, 151 aa, Homo sapiens
MGVMAPRTLLLLLLGALALTETWAGSHSLRYFSTAVSQPGRGEPRFIAVGYVDDTEFVRFDSDSVSPRMERRAPWVEQEGLEYWDQETRNAKGHAQIYRVNLRTLLRYYNQSEAGHGSHTIQRKHGCDVGPTGASSAGMNSSPTMARITSP

SEQ ID NO: 1090 - protein, 539 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 1091 - protein, 539 aa, Homo sapiens; identical to SEQ ID NO: 1090

SEQ ID NO: 1092 - protein, 539 aa, Homo sapiens; identical to SEQ ID NO: 1090

SEQ ID NO: 1093 - protein, 313 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQVRGRPWAGRQGPGRWVPALPFTCRTLEDLGAQFCHLKHGDDNPYCCQLVCRLHEHKMK

SEQ ID NO: 1094 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 1095 - protein, 126 aa, Homo sapiens; identical to SEQ ID NO: 1094

SEQ ID NO: 1096 - protein, 126 aa, Homo sapiens; identical to SEQ ID NO: 1094

SEQ ID NO: 1097 - protein, 467 aa, Homo sapiens [sequence omitted]

SEQ ID NO: 1098 - protein, 474 aa, Homo sapiens [sequence omitted]

SEQ ID NO: 1099 - protein, 183 aa, Homo sapiens
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 1100 - protein, 170 aa, Homo sapiens
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPVSTELLT

SEQ ID NO: 1101 - protein, 210 aa, Homo sapiens
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 1102 - protein, 183 aa, Homo sapiens
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQAENISKDLYIEVYPGTYSVTVGSNDLTKKTHVVAVDSGQSVDLVFPV

SEQ ID NO: 1103 - protein, 210 aa, Homo sapiens; identical to SEQ ID NO: 1101

SEQ ID NO: 1104 - protein, 1358 aa, Homo sapiens [sequence omitted]

SEQ ID NO: 1105 - protein, 689 aa, Homo sapiens
MNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 1106 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 1107 - protein, 976 aa, Homo sapiens; identical to SEQ ID NO: 1106

SEQ ID NO: 1108 - protein, 3578 aa, Homo sapiens [sequence omitted]

SEQ ID NO: 1109 - protein, 3590 aa, Homo sapiens [sequence omitted]

SEQ ID NO: 1110 - protein, 4962 aa, Homo sapiens [sequence omitted]

SEQ ID NO: 1111 - protein, 4967 aa, Homo sapiens
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTPLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLARTMRTERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 1112 - protein, 280 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 1113 - protein, 223 aa, Homo sapiens
MQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 1114 - protein, 318 aa, Homo sapiens
MSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 1115 - protein, 256 aa, Homo sapiens
LDLQNTSESPGSSEACGTNPGSQNREKGVAGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 1116 - protein, 230 aa, Homo sapiens
MHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 1117 - protein, 336 aa, Homo sapiens
MVTAFRSLPRGSSGAAASMSAHNRGTELDLSWISKIQVNHPAVLRRAEQIQARRTVKKEWQAAWLLKAVTFIDLTTLSGDDTSSNIQRLCYKAKYPIREDLLKALNMHDKGITTAAVCVYPARVCDAVKALKAAGCNIPVASVAAGFPAGQTHLKTRLEEIRLAVEDGATEIDVVINRSLVLTGQWEALYDEIRQFRKACGEAHLKTILATGELGTLTNVYKASMIAMMAGSDFIKTSTGKETVNATFPVAIVMLRAIRDFFWKTGNKIGFKPAGGIRSAKDSLAWLSLVKEELGDEWLKPELFRIGASTLLSDIERQIYHHVTGRYAAYHDLPMS

SEQ ID NO: 1118 - protein, 2225 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEIITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGNKATIIVQKQ

SEQ ID NO: 1119 - protein, 2382 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEIITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 1120 - protein, 1246 aa, Homo sapiens [sequence omitted]

SEQ ID NO: 1121 - protein, 2107 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQGIQQTAPPQQTVQYSLSQTSTSSEATTAQPVSQPQAPQVLPQVSAGKQSTQGVSQVAPAEPVAVAQPQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEIITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 1122 - protein, 1304 aa, Homo sapiens
MSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLSIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEIITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 1123 - protein, 2107 aa, Homo sapiens; identical to SEQ ID NO: 1121

SEQ ID NO: 1124 - protein, 2382 aa, Homo sapiens; identical to SEQ ID NO: 1119

SEQ ID NO: 1125 - protein, 2144 aa, Homo sapiens [sequence omitted]

SEQ ID NO: 1126 - protein, 2036 aa, Homo sapiens [sequence omitted]

SEQ ID NO: 1127 - protein, 2036 aa, Homo sapiens [sequence omitted]

SEQ ID NO: 1128 - protein, 2036 aa, Homo sapiens [sequence omitted]

SEQ ID NO: 1129 - protein, 408 aa, Homo sapiens
MPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLNQVNISKTDEAFFDSENDPEKCCLLLQFILNCLYKIFLFDTQHFISKERAEALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 1130 - protein, 2044 aa, Homo sapiens [sequence omitted]

SEQ ID NO: 1131 - protein, 897 aa, Homo sapiens
MEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNDFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLSTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASRANIRLTSLKKTLATTLAPRVLLPAIKKTYKQIEKNWKNHMGPFMSILQEHIGAMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLDQVNISKTDEAFFDSENDPEKCCLLLQFILNCLYKIFLFDTQHFISKERAGALMMPLVDQLVNRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 1132 - protein, 165 aa, Homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 1133 - protein, 626 aa, Homo sapiens [sequence omitted]

SEQ ID NO: 1134 - protein, 408 aa, Homo sapiens
MSETFKNLTSVARIFLHKPELITKLEQEEEQWRETRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 1135 - protein, 442 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAAYSVVSGNLMITWWSSLFLLGVLFQGYLGCLRSHSVLGRRKVGDMWILFFLWLWTSFNTAFLALQSLRFGFGFRRGRSFLLRSWHHLMKRVQIKIFD

SEQ ID NO: 1136 - protein, 362 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAVTDSAQGSGVSLTANKV

SEQ ID NO: 1137 - protein, 253 aa, Homo sapiens [sequence omitted]

SEQ ID NO: 1138 - protein, 229 aa, Homo sapiens [sequence omitted]

SEQ ID NO: 1139 - protein, 108 aa, Homo sapiens
MEVGWYRPPFSRVVHLYRNGKDQDGDQAPEYRGRTELLKDAIGEGKVTLRIRNVRFSDEGGFTCFFRDHSYQEEAAMELKVEVSHSVTQDWLQWHDHGSLQPPPPRLK

SEQ ID NO: 1140 - protein, 205 aa, Homo sapiens [sequence omitted]

SEQ ID NO: 1141 - protein, 131 aa, Homo sapiens [sequence omitted]

SEQ ID NO: 1142 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 1143 - protein, 345 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 1144 - protein, 345 aa, Homo sapiens; identical to SEQ ID NO: 1143

SEQ ID NO: 1145 - protein, 345 aa, Homo sapiens; identical to SEQ ID NO: 1143

SEQ ID NO: 1146 - protein, 359 aa, Homo sapiens
MLPCFQLLRIGGGRGGDLYTFHPPAGVGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEVGTTPSAPPQRNRRKSVHRVLAELDDESEPPENPPPVLMEPRKKLRVDKAPLTPTGNARGRPRKYPVSAPMAPPAVGAGSPVQLLVAACPRKRQWPGFSVMAVTSGSMWPVLAAASRLPGRPTSDAQGAGLAFSLRSTAKAPSDTPAHE

SEQ ID NO: 1147 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 1148 - protein, 265 aa, Homo sapiens
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 1149 - protein, 265 aa, Homo sapiens
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGAPGYGSPHFTALYSSVPFPEGEAFPPVSVTTLGSPLHSN

SEQ ID NO: 1150 - protein, 993 aa, Homo sapiens [sequence omitted]

SEQ ID NO: 1151 - protein, 364 aa, Homo sapiens [sequence omitted]

SEQ ID NO: 1152 - protein, 523 aa, Homo sapiens
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 1153 - protein, 523 aa, Homo sapiens; identical to SEQ ID NO: 1152

SEQ ID NO: 1154 - protein, 523 aa, Homo sapiens
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIIIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGLTFHCLLKMMSWALQKMSSAAGVYIFIQSIAGLAGPPLAGLLVDQSKIYSRAFYSCAAGMALAAVCLALVRPCKMGLCQRHHSGETKVVSHRGKTLQDIPEDFLEMDLAKNEHRVHVQMEPV

SEQ ID NO: 1155 - protein, 898 aa, Homo sapiens
MSVTEEDLCHHMKVVVRVRPENTKEKAAGFHKVVHVVDKHILVFDPKQEEVSFFHGKKTTNQNVIKKQNKDLKFVFDAVFDETSTQSEVFEHTTKPILRSFLNGYNCTVLAYGATGAGKTHTMLGSADEPGVMYLTMLHLYKCMDEIKEEKICSTAVSYLEVYNEQIRDLLVNSGPLAVREDTQKGVVVHGLTLHQPKSSEEILHLLDNGNKNRTQHPTDMNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTAEQPKQNDLPGISVLMTFPQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAISSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 1156 - protein, 228 aa, Homo sapiens; identical to SEQ ID NO: 1027

SEQ ID NO: 1157 - protein, 305 aa, Homo sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 1158 - protein, 305 aa, Homo sapiens; identical to SEQ ID NO: 1157

SEQ ID NO: 1159 - protein, 305 aa, Homo sapiens; identical to SEQ ID NO: 1157

SEQ ID NO: 1160 - protein, 305 aa, Homo sapiens; identical to SEQ ID NO: 1157

SEQ ID NO: 1161 - protein, 1335 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 1162 - protein, 1337 aa, Homo sapiens [sequence omitted]

SEQ ID NO: 1163 - protein, 1092 aa, Homo sapiens [sequence omitted]

SEQ ID NO: 1164 - protein, 1103 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 1165 - protein, 411 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 1166 - protein, 1337 aa, Homo sapiens [sequence omitted]

SEQ ID NO: 1167 - protein, 923 aa, Homo sapiens
MQYLTLTFVYSLFQKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 1168 - protein, 923 aa, Homo sapiens; identical to SEQ ID NO: 1167

SEQ ID NO: 1169 - protein, 413 aa, Homo sapiens
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 1170 - protein, 409 aa, Homo sapiens
MHFCGKHIINHFYKILQLMPLACIDISLNENIIILGKVNFSFTLLLPFQFFIFSFLYFHHLCCIEINSAEGRKKVSSTCSAHITVVIVFHRTILFMYIKSTSNRNYSAMTEFFLVGLSQYPELQLFLFLLCLIMYMIILLGNSLLIIITILDSRLHTPMYFFLGNLSFLDICYTSSSIPPMLIIFMSERKSISFIGCALQMVVSLGLGSTECVLLAVMAYDHYVAICNPLRYSIIMNGVLYVQMAAWSWIIGCLTSLLQTVLTMMLPFCGNNVIDHITCEILALLKLVCSDITINVLIMTVTNIVSLVILLLLIFISYVFILSSILRINCAEGRKKAFSTCSAHSIVVILFYGSALFMYMKPKSKNTNTSDEIIGLSYGVVSPMLNPIIYSLRNKEVKEAVKKVLSRHL

SEQ ID NO: 1171 - protein, 2201 aa, Homo sapiens [sequence omitted]

SEQ ID NO: 1172 - protein, 2201 aa, Homo sapiens [sequence omitted]

SEQ ID NO: 1173 - protein, 2201 aa, Homo sapiens [sequence omitted]

SEQ ID NO: 1174 - protein, 403 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMKKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 1175 - protein, 394 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMRKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 1176 - protein, 407 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMNIHFRGKTKSFPEGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 1177 - protein, 155 aa, Homo sapiens
MASLKCSTVVCVICLEKPKYRCPACRVPYCSVVCFRKHKEQCNPETRPVEKKIRSALPTKTVKPVENKDDDDSIADFLNSDEEEDRVSLQNLKNLGESATLRSLLLNPHLRQLMVNLDQGEDKAKLMRAYMQEPLFVEFADCCLGIVEPSQNEES

SEQ ID NO: 1178 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGIGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 1179 - protein, 837 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEASTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLKNQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 1180 - protein, 474 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEASTNKELQILLLVEAGVNFFLLSQSVQEKAWLHSQPTLKFRDPATPKT

SEQ ID NO: 1181 - protein, 180 aa, Homo sapiens
MSSGRGAWGRGCSSVELITPTVELRWPEMPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 1182 - protein, 180 aa, Homo sapiens; identical to SEQ ID NO: 1181

SEQ ID NO: 1183 - protein, 181 aa, Homo sapiens
MSSGRGAWGRGCSSVELITPTVELRWPEMPAHSLVMSSPALPAFLLCSTLLVIKMYVVAIITGQVRLRKKAFANPEDALRHGGPQYCRSDPDVERCLRQAHRNDMETIYPFLFLGFVYSFLGPNPFVAWMHFLVFLVGRVAHTVAYLGKLRAPIRSVTYTLAQLPCASMALQILWEAARHL

SEQ ID NO: 1184 - protein, 136 aa, Homo sapiens [sequence omitted]

SEQ ID NO: 1185 - protein, 136 aa, Homo sapiens [sequence omitted]

SEQ ID NO: 1186 - protein, 152 aa, Homo sapiens
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 1187 - protein, 1901 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESNGNSSSWSSLGLEGDLYEDNLSFPTSDSDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 1188 - protein, 315 aa, Homo sapiens
MLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTSYCWFQACVERTCGPSVELSPWKWQTRCGREGNSWKRE

SEQ ID NO: 1189 - protein, 239 aa, Homo sapiens
MAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 1190 - protein, 375 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 1191 - protein, 265 aa, Homo sapiens
MQRNWKLLTSKINWKKRKVRSTTQLRISQMASHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 1192 - protein, 375 aa, Homo sapiens; identical to SEQ ID NO: 1190

SEQ ID NO: 1193 - protein, 145 aa, Homo sapiens [sequence omitted]

SEQ ID NO: 1194 - protein, 375 aa, Homo sapiens
MDALQLANSAFAVDLFKQLCEKEPLGNVLFSPICLSTSLSLAQVGAKGDTANEIGQVLHFENVKDIPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFPESETKECPFRLNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 1195 - protein, 213 aa, Homo sapiens
MAAAADERSPEDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 1196 - protein, 1234 aa, Homo sapiens
MKEEVKGIPVRVALRCRPLVPKEISEGCQMCLSFVPGETQVVVGTDKSFTYDFVFDPCTEQEEVFNKAVAPLIKGIFKGYNATVLAYGQTGSGKTYSMGGAYTAEQENEPTVGIIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISIEQRKKSDKNCSFRSKLHLVDLAGSERQKKTKAEGDRLKEGININRGLLCLGNVISALGDDKKGSFVPYRDSKLTRLLQDSLGGNSHTLMIACVSPADSNLEETLSTLRYADRARKIKNKPIVNIDPHTAELNHLKQQVQQLQVLLLQAHGGTLPGSINAEPSENLQSLMEKNQSLVEENEKLSRCLSKAAGQTAQMLERIILTEQVNEKLNAKLEELRQHVACKLDLQKLVETLEDQELKENVEIICNLQQLITQLSDETVACTAAAIDTAVEEEAQVETSPETSRSSDAFTTQHALHQAQMSKEVVELNNALALKEALVRKMTQNDNQLQPIQFQYQDNIKNLELEVINLQKEKEELVRELQTAKKNVNQAKLSEHRHKLLQELEGQIADLKKKLNEQSKLLKLKESTERTVSKLNQEIWMMKNQRVQLMRQMKEDAEKFRQWKQKKDKEVIQLKERDRKRQYELLKLERNFQKQSSVLRRKTEEAAAANKRLKDALQKQREVTDKRKETQSHGKEGIAARVRNWLGNEIEVMVSTEEAKRHLNDLLEDRKILAQDVVQLKEKKESRENPPPKLRKCTFSLSEVHGQVLESEDCITKQIESLETEMELRSAQIADLQQKLLDAESEDRPKQCWENIATILEAKCALKYLIGELVSSKIHVTKLENSLRQSKASCADMQKMLFEEQNHFSEIETELQAELVRMEQQHQEKVLYLVSQLQESQMAEKQLEKSASEKEQQLVSTLQCQDEELEKMREVCEQNQQLLQENEIIKQKLILLQVASRQKHLPNDTLLSPDSSFEYIPPKPKPSRVKEKFLEQSMDIEDLKYCSEHSVNEHEDGDGDGDSDEGDDEEWKPTKLVKVSRKNIQGCSCKGWCGNKQCGCRKQKSDCGVDCSCDPTKCRNRQQGKDSLGTVEQTQDSEGSFKLEDPTEVTPGLSFFNPVCATPNSKILKEMCDMEQVLSKKTAPAPSPFDLPESKHGATEYQQNKPPGKKKKRALASNTSFFSGCSPIEEEAH

SEQ ID NO: 1197 - protein, 486 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEYKGHKILNIVDCTRPNGGRLPMKVALMMSDFAGGASGFPMTFSGGKFTEEWKAQFIKTERKKLLNYKARLVKNLQPRIYCPFAGYFVESHPSDKYIKETNTKNDPNELNNLIKKNSDVITWTPRPGATLDLGRMLKDRTDSKGIIEPPEGTKIYKDSWDFEPYLEILNAALGDEIFLHSSWIKEYFTWAGFKDYNLVVRMIETDEDFNPFPGGYDYLVDFLDLSFPKERPQREHPYEEIHSRVDVIRHVVKNGLLWDELYIGFQTRLQRDPDIYHHLFWNHFQIKLPLTPPNWKSFLMCCEQNGPAILQECKTT

SEQ ID NO: 1198 - protein, 486 aa, Homo sapiens; identical to SEQ ID NO: 1197

SEQ ID NO: 1199 - protein, 486 aa, Homo sapiens; identical to SEQ ID NO: 1197

SEQ ID NO: 1200 - protein, 1475 aa, Homo sapiens [sequence omitted]

SEQ ID NO: 1201 - protein, 1475 aa, Homo sapiens [sequence omitted]

SEQ ID NO: 1202 - protein, 1475 aa, Homo sapiens [sequence omitted]

SEQ ID NO: 1203 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 1204 - protein, 777 aa, Homo sapiens; identical to SEQ ID NO: 1203

SEQ ID NO: 1205 - protein, 97 aa, Homo sapiens
MAQKRPACTLKPECVQQLLVCSQEAKKSAYCPYSHFPVGAALLTQEGRIFKGCNIENACYPLGICAERTAIQKAVSEGYKDFRAIAIASLAPTGPCT

SEQ ID NO: 1206 - protein, 146 aa, Homo sapiens [sequence omitted]

SEQ ID NO: 1207 - protein, 622 aa, Homo sapiens
MCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVENTQGHILYAFLVENKERESRVVHFAVLKAETATSVAKMLSIFTEFNSDWPKVKVVFVDPSFHYRAILQEIFPAARILLSIYHTTRLLEKKLHRSSANPSFKRLMKEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 1208 - protein, 696 aa, Homo sapiens
MELGSCFKTYEDFKECFSAYKRENRCSFILRDCVSVRFHNLNHGTSIREDILYVQVKFVCIRTQSNRKRTREADMCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVENTQGHILYAFLVENKERESRVVHFAVLKAETATSVAKMLSIFTEFNSDWPKVKVVFVDPSFHYRAILQEIFPAARILLSIYHTTRLLEKKLHRSSANPSFKSLMKEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 1209 - protein, 701 aa, Homo sapiens [sequence omitted]

SEQ ID NO: 1210 - protein, 655 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 1211 - protein, 655 aa, Homo sapiens; identical to SEQ ID NO: 1210

SEQ ID NO: 1212 - protein, 703 aa, Homo sapiens [sequence omitted]

SEQ ID NO: 1213 - protein, 427 aa, Homo sapiens [sequence omitted]

SEQ ID NO: 1214 - protein, 714 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWSTSGNSSYRYTCREGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 1215 - protein, 317 aa, Homo sapiens [sequence omitted]

SEQ ID NO: 1216 - protein, 317 aa, Homo sapiens [sequence omitted]

SEQ ID NO: 1217 - protein, 317 aa, Homo sapiens
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEGTTETGGQGKGTSKTTTSPNGGFEPTTPPQVYRTTSPPFGKTTTVEYEGEYEYTGVNEYDNGYEIYESENGEPRGDNYRAYEDEYSYFKGQGYDGYDGQNYYHHQ

SEQ ID NO: 1218 - protein, 972 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 1219 - protein, 972 aa, Homo sapiens; identical to SEQ ID NO: 1218

SEQ ID NO: 1220 - protein, 1292 aa, Homo sapiens
MDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGADLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 1221 - protein, 783 aa, Homo sapiens [sequence omitted]

SEQ ID NO: 1222 - protein, 807 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 1223 - protein, 179 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKEAEKRKSDYIIRTLKVKFNSVSVILAHQTSLQNLFSQITPAHF

SEQ ID NO: 1224 - protein, 691 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSGKNFSWL

SEQ ID NO: 1225 - protein, 802 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 1226 - protein, 794 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKPLLCDMYIFKHIF

SEQ ID NO: 1227 - protein, 754 aa, Homo sapiens
MAAQVGAVRVVRAVAAQEEPDKEGKEKPHAGVSPRGVKRQRRSSSGGSQEKRGRPSQEPPLAPPHRRRRSRRHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIKKKKKKKHREDMRGRRLKMYNKEVQTVCAGLTRISKEILTQGQINSTSGLNKESFRYLKDEQLCRLNLGMQEYRVPQGVQTPFMTHQEHSIRRNFLKTGTKFSNFIHEEHQSNGGALVLHAYMDELSFLSPMEMERFSEEFLALTFSENEKNAAYYALAIVHGAAAYLPDFLDYFAFNFPNTPVKMEILGKKDIETTTISNFHTQVNRTYCCGTYRAGPMRQISLVGAVDEEVGDYFPEFLDMLEESPFLKMTLPWGTLSSLRLQCRSQSDDGPIMWVRPGEQMIPTADMPKSPFKRRRSMNEIKNLQYLPRTSEPREVLFEDRTRAHADHVGQGFDWQSTAAVGVLKAVQFGEWSDQPRITKDVICFHAEDFTDVVQRLQLDLHEPPVSQCVQWVDEAKLNQMRREGIRYARIQLCDNDIYFIPRNVIHQFKTVSAVCSLAWHIRLKQYHPVVEATQNTESNSNMDCGLTGKRELEVDSQCVRIKTESEEACTEIQLLTTASSSFPPASELNLQQDQKTQPIPVLKVESRLDSDQQHNLQEHSTTSV

SEQ ID NO: 1228 - protein, 602 aa, Homo sapiens
MSERRRSAVALSSRAHAFSVEALIGSNKKRKLRDWEEKGLDLSMEALSPAGPLGDTEDAAAHGLEPHPDSEQSTGSDSEVLTERTSCSFSTHTDLASGAAGPVPAAMSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 1229 - protein, 222 aa, Homo sapiens
MPGQISEVEQEKSSLLHLLQGGIKVPKRGCSLGAPGTMVKLGNNFAEKGTKQPLLEDGFDTIPLMTPLDVNQLQFPPPDKVVVKTKTEYEPDRKKGKARPPQIAEFTVSITEGVTERFKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 1230 - protein, 185 aa, Homo sapiens
MVKLGNNFAEKGTKQPLLEDGFDTIPLMTPLDVNQLQFPPPDKVVVKTKTEYEPDRKKGKARPPQIAEFTVSITEGVTERFKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 1231 - protein, 185 aa, Homo sapiens; identical to SEQ ID NO: 1230

SEQ ID NO: 1232 - protein, 222 aa, Homo sapiens; identical to SEQ ID NO: 1229

SEQ ID NO: 1233 - protein, 259 aa, Homo sapiens
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLAFAGGIKEGQAYLGDITDLSWNQNQIQRQENPHLLRKFHRVLQKTLKKTLPLKNVQKKFWLKHNLNWERGEMAKAKMSYPQKKYKCLNRKISD

SEQ ID NO: 1234 - protein, 94 aa, Homo sapiens [sequence omitted]

SEQ ID NO: 1235 - protein, 335 aa, Homo sapiens
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 1236 - protein, 368 aa, Homo sapiens [sequence omitted]

SEQ ID NO: 1237 - protein, 476 aa, Homo sapiens [sequence omitted]

SEQ ID NO: 1238 - protein, 680 aa, Homo sapiens [sequence omitted]

SEQ ID NO: 1239 - protein, 315 aa, Homo sapiens
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNNRTTGNSGSRNDQHGVGE

SEQ ID NO: 1240 - protein, 137 aa, Homo sapiens [sequence omitted]

SEQ ID NO: 1241 - protein, 321 aa, Homo sapiens
MADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 1242 - protein, 286 aa, Homo sapiens
MEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 1243 - protein, 377 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 1244 - protein, 321 aa, Homo sapiens; identical to SEQ ID NO: 1241

SEQ ID NO: 1245 - protein, 286 aa, Homo sapiens; identical to SEQ ID NO: 1242

SEQ ID NO: 1246 - protein, 377 aa, Homo sapiens; identical to SEQ ID NO: 1243

SEQ ID NO: 1247 - protein, 533 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTVSKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 1248 - protein, 533 aa, Homo sapiens; identical to SEQ ID NO: 1247

SEQ ID NO: 1249 - protein, 533 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSLVVPGAIVAAMGIVCFLFLIEHPNDVRCSSTLVTHSKGYENGTNRLRLQKQILKSEKNKPLDPEMQCLLLSDGKGSIHPNQVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTISKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 1250 - protein, 242 aa, Homo sapiens
MAGSVGLALCGQTLVVRGGSRFLATSIASSDDDSLFIYDCSAAEKKSQENKGEDAPLDQGSGAILASTFSNSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEFVSRISVVPTQPGLLLSSSGDGTLRLWEYRSGRQLHCCHLASLQELVDPQAPQ

SEQ ID NO: 1251 - protein, 412 aa, Homo sapiens [sequence omitted]

SEQ ID NO: 1252 - protein, 266 aa, Homo sapiens
MLLDVAVSPDDRFILTADRDEKIRVSWAAAPHSIESFCLGHTEFVSRISVVPTQPGLLLSSSGDGTLRLWEYRSGRQLHCCHLASLQELVDPQAPQKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 1253 - protein, 412 aa, Homo sapiens [sequence omitted]

SEQ ID NO: 1254 - protein, 551 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 1255 - protein, 565 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPADHSTGKSSQRQMVFGVVTAIDLLNFVAAQERDQK

SEQ ID NO: 1256 - protein, 446 aa, Homo sapiens
MAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 1257 - protein, 292 aa, Homo sapiens
  VARIANT (1)...(292): Xaa = Any Amino Acid
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCIIGVDPEGSILAEPEEX

SEQ ID NO: 1258 - protein, 570 aa, Homo sapiens
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPAGSPNQVFLEHVHACHHRLWLLSSTSGLRAHNRDGTAPKT

SEQ ID NO: 1259 - protein, 551 aa, Homo sapiens; identical to SEQ ID NO: 1254

SEQ ID NO: 1260 - protein, 551 aa, Homo sapiens; identical to SEQ ID NO: 1254

SEQ ID NO: 1261 - protein, 628 aa, Homo sapiens [sequence omitted]

SEQ ID NO: 1262 - protein, 554 aa, Homo sapiens
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSSSPQLQESVFHLLVPSVILVLLAVGGLLFYRWRRRSHQEPQRADSPLEQPEGSPLTQDDRQVELPV

SEQ ID NO: 1263 - protein, 512 aa, Homo sapiens
MPPSPLLKGCAEGWPVRLGPGKVKVCLGPLGARAALRIPGQRCGPRPGRPLRSSQRASERARAADAPGRDPAARMTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGHERQSEGSSSPQLQESVFHLLVPSVILVLLAVGGLLFYRWRRRSHQEPQRADSPLEQPEGSPLTQDDRQVELPV

SEQ ID NO: 1264 - protein, 330 aa, Homo sapiens
MPPSPLLKGCAEGWPVRLGPGKVKVCLGPLGARAALRIPGQRCGPRPGRPLRSSQRASERARAADAPGRDPAARMTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQGHERQSEGSSSPQLQESVFHLLVPSVILVLLAVGGLLFYRWRRRSHQEPQRADSPLEQPEGSPLTQDDRQVELPV

SEQ ID NO: 1265 - protein, 150 aa, Homo sapiens
MCLLCPFPIGKAISVRLQYFKHETKQSICLGNQKSPLVCPFFGEQGLDSSSSLDLPSSPHPAPTLCPCVQPPRGPVSVSVPVSVMGSRLAPLLSACLFVSVILGRMVILKNPGVLGQRQAGPSPGAPGLPSPSVRAPLGHKCSERSPSAT

SEQ ID NO: 1266 - protein, 150 aa, Homo sapiens; identical to SEQ ID NO: 1265

SEQ ID NO: 1267 - protein, 580 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASASQSAGITGVSHCTWPCCNPVFFSRDRVSPCWPGWSRTPDLR

SEQ ID NO: 1268 - protein, 1823 aa, Homo sapiens
MMMVGQGPMKRLTTLKSSSSAMRKMGETLMRRELRATGIPNQLLVRNGPLKQMAKRATPPTANRPLLRRPGQKPLGLQRQSRDLLPQSLPYPHLTGDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1269 - protein, 2108 aa, Homo sapiens [sequence omitted]

SEQ ID NO: 1270 - protein, 2102 aa, Homo sapiens [sequence omitted]

SEQ ID NO: 1271 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1272 - protein, 2779 aa, Homo sapiens
LKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKANVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRAVPS

SEQ ID NO: 1273 - protein, 804 aa, Homo sapiens [sequence omitted]

SEQ ID NO: 1274 - protein, 777 aa, Homo sapiens [sequence omitted]

SEQ ID NO: 1275 - protein, 805 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGHFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 1276 - protein, 805 aa, Homo sapiens; identical to SEQ ID NO: 1275

SEQ ID NO: 1277 - protein, 761 aa, Homo sapiens [sequence omitted]

SEQ ID NO: 1278 - protein, 90 aa, Homo sapiens
MSDSTWLTSEIHNPLAVGQYVNNCSNDRAANVCYQEFDVPAVFPIELKQYLPNIAYSYDKQSPLRCVVLVALRDINQGEELFSNYYTIVS

SEQ ID NO: 1279 - protein, 299 aa, Homo sapiens [sequence omitted]

SEQ ID NO: 1280 - protein, 250 aa, Homo sapiens [sequence omitted]

SEQ ID NO: 1281 - protein, 555 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAGRE

SEQ ID NO: 1282 - protein, 508 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAGREV

SEQ ID NO: 1283 - protein, 418 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDL

SEQ ID NO: 1284 - protein, 882 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 1285 - protein, 624 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPHPLLASPLLASPLLASPVSAESTRSLQPALWHIPPPSLASPPAR

SEQ ID NO: 1286 - protein, 829 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGESRAQTLGAGVPPGDSVRGSMEASQVQVPLEASPITFPPPCAPERPPISPVPGARQAGL

SEQ ID NO: 1287 - protein, 435 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLVPPPAHALTGPAQSSTH

SEQ ID NO: 1288 - protein, 585 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 1289 - protein, 611 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQARTPASPHFRSQGAQPQQVTLRLALRLGNFPVRH

SEQ ID NO: 1290 - protein, 781 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 1291 - protein, 824 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLAEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 1292 - protein, 633 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 1293 - protein, 611 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLAEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 1294 - protein, 423 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLRNALW

SEQ ID NO: 1295 - protein, 882 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 1296 - protein, 79 aa, Homo sapiens
MELEAMSRYTSPVNPAVFPHLTVVLLAIGMFFTAWFFVYEVTSTKYTRDIYKELLISLVASLFMGFGVLFLLLWVGIYV

SEQ ID NO: 1297 - protein, 78 aa, Homo sapiens
MLEAMSRYTSPVNPAVFPHLTVVLLAIGMFFTAWFFVYEVTSTKYTRDIYKELLISLVASLFMGFGVLFLLLWVGIYV

SEQ ID NO: 1298 - protein, 509 aa, Homo sapiens
MGVQAGLFGMLGFLGVALGGSPALRWYRTSCHLTKAVPGNPLGYLSFLAKDAQGLALIHARWDAHRRLQACSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 1299 - protein, 337 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 1300 - protein, 337 aa, Homo sapiens; identical to SEQ ID NO: 1299

SEQ ID NO: 1301 - protein, 337 aa, Homo sapiens; identical to SEQ ID NO: 1299

SEQ ID NO: 1302 - protein, 687 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 1303 - protein, 641 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 1304 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 1305 - protein, 687 aa, Homo sapiens; identical to SEQ ID NO: 1302

SEQ ID NO: 1306 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 1307 - protein, 641 aa, Homo sapiens; identical to SEQ ID NO: 1303

SEQ ID NO: 1308 - protein, 537 aa, Homo sapiens; identical to SEQ ID NO: 1304

SEQ ID NO: 1309 - protein, 794 aa, Homo sapiens [sequence omitted]

SEQ ID NO: 1310 - protein, 132 aa, Homo sapiens
  VARIANT (1)...(132): Xaa = Any Amino Acid
MEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKX

SEQ ID NO: 1311 - protein, 132 aa, Homo sapiens; identical to SEQ ID NO: 1310
  VARIANT (1)...(132): Xaa = Any Amino Acid

SEQ ID NO: 1312 - protein, 159 aa, Homo sapiens
MEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKMILMYEEKAREKEKPTGPPAKKAISELP

SEQ ID NO: 1313 - protein, 93 aa, Homo sapiens
MEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 1314 - protein, 147 aa, Homo sapiens
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 1315 - protein, 93 aa, Homo sapiens; identical to SEQ ID NO: 1313

SEQ ID NO: 1316 - protein, 132 aa, Homo sapiens
MEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKM

SEQ ID NO: 1317 - protein, 132 aa, Homo sapiens; identical to SEQ ID NO: 1316

SEQ ID NO: 1318 - protein, 93 aa, Homo sapiens; identical to SEQ ID NO: 1313

SEQ ID NO: 1319 - protein, 454 aa, Homo sapiens
  VARIANT (1)...(454): Xaa = Any Amino Acid
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSX

SEQ ID NO: 1320 - protein, 477 aa, Homo sapiens [sequence omitted]

SEQ ID NO: 1321 - protein, 455 aa, Homo sapiens [sequence omitted]

SEQ ID NO: 1322 - protein, 133 aa, Homo sapiens
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 1323 - protein, 382 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 1324 - protein, 297 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRDASIPQFKPEIQVYENIHLARLGPPAHKPR

SEQ ID NO: 1325 - protein, 382 aa, Homo sapiens; identical to SEQ ID NO: 1323

SEQ ID NO: 1326 - protein, 852 aa, Homo sapiens
MLPTEVPQSHPGPSALLLLQLLLPPTSAFFPNIWSLLAAPGSITHQDLTEEAALNVTLQLFLEQPPPGRPPLRLEDFLGRTLLADDLFAAYFGPGSSRRFRAALGEVSRANAAQDFLPTSRNDPDLHFDAERLGQGRARLVGALRETVVAARALDHTLARQRLGAALHALQDFYSHSNWVELGEQQPHPHLLWPRQELQNLAQVADPTCSDCEELSCPRNWLGFTLLTSGYFGTHPPKPPGKCSHGGHFDRSSSQPPRGGINKDSTSPGFSPHHMLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQVRNYYFPSQGPAHHPYRLI

SEQ ID NO: 1327 - protein, 578 aa, Homo sapiens
MLHLQAAKLALLASIQAFSLLRSRLGDRDFSRLLDITPASSLSFVLDTTGSMGEEINAAKIQARHLVEQRRGSPMEPVHYVLVPFHDPGFGPVFTTSDPDSFWQQLNEIHALGGGDEPEMCLSALQLALLHTPPLSDIFVFTDASPKDAFLTNQVESLTQERRCRVTFLVTEDTSRVQGRARREILSPLRFEPYKAVALASGGEVIFTKDQHIRDVAAIVGESMAALVTLPLDPPVVVPGQPLVFSVDGLLQKITVRIHGDISSFWIKNPAGVSQGQEEGGGPLGHTRRFGQFWMVTMDDPPQTGTWEIQVTAEDTPGVRVQAQTSLDFLFHFGIPMEDGPHPGLYPLTQPVAGLQTQLLVEVTGLGSRANPGDPQPHFSHVILRGVPEGAELGQVPLEPVGPPERGLLAASLSPTLLSTPRPFSLELIGQDAAGRRLHRAAPQPSTVVPVLLELSGPSGFLAPGSKVPLSLRIASFSGPQDLDLRTFVNPSFSLTSNLSRAHLELNESAWGRLWLEVPDSAAPDSVVMVTVTAGGREANPVPPTHAFLRLLVSAPAPQVRNYYFPSQGPAHHPYRLI

SEQ ID NO: 1328 - protein, 852 aa, Homo sapiens; identical to SEQ ID NO: 1326

SEQ ID NO: 1329 - protein, 601 aa, Homo sapiens
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 1330 - protein, 339 aa, Homo sapiens
MLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 1331 - protein, 339 aa, Homo sapiens; identical to SEQ ID NO: 1330

SEQ ID NO: 1332 - protein, 558 aa, Homo sapiens
MAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 1333 - protein, 469 aa, Homo sapiens
MPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 1334 - protein, 103 aa, Homo sapiens
MNQEDPGWRGGVVAQGPWPFLLCVPALWETTWRSAMMLSCCLLWVLPFRMNWTMSEPSFPRKTRRNETARSSSTLCGIRWKNAMLLWYLCSRPWARPRCCAPH

SEQ ID NO: 1335 - protein, 469 aa, Homo sapiens
MPIRALCTICSDFFDHSRDVAAIHCGHTFHLQCLIQSFETAPSRTCPQCRIQVGKRTIINKLFFDLAQEEENVLDREFLKNELDNVRAQLSQKDKEKRDSQVIIDTLRDTLEERNATVVSLQQALGKAEMLCSTLKKQMKYLEQQQDETKQAQEEAGRLRSKMKTMEQIELLLQSQLPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 1336 - protein, 167 aa, Homo sapiens
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWRKLVDKAPLRQATEAPIPGNVHKVINWKKSKNPRPK

SEQ ID NO: 1337 - protein, 376 aa, Homo sapiens
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWRKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 1338 - protein, 538 aa, Homo sapiens
MATRRLGVGETLGALNAALGPGGPVWIKETRTRHLRSRDFLAPHRALQARFDDGQVPEHLLHALACLQGPGVAPVLRCAPTPAGLSLQLQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWRKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNREPRPHLFGQMFVRLQLLRAVREVLHTGLAMLGLPPLSHI

SEQ ID NO: 1339 - DNA, 201 bp, Homo sapiens
tgaccggcctcagtgacaaaaagtttcagagacctcatgactattccccaccttttcgatttgggacagtgcctaatggaagcacggagagaaacattcgsaataactatccctacatgcatcagtacatgaccaaatttaatcagaaaggagtagaggacgccttggtcagcctgaaaacggggaagctggacgctttca

SEQ ID NO: 1340 - DNA, 201 bp, Homo sapiens
aagaccacagtggacaacagctttgtgggctgggacatgcagaatgtgatcacactggacacttcctttgaggatgcaaagacacaagtccagctgaagargatccactcttctgtcatcttgctctactgttccaaagacgaggctgttctcattctgagtgaggcccgctcccttggcctcaccgggtatgatttcttc

SEQ ID NO: 1341 - DNA, 201 bp, Homo sapiens
catggtttcagataaggggaatttgatgtactcagacaacaggtcctttcaggggaaagagagcatttttggagacaacatgaacgaactccaaacatttstggccaaccggcagaaggataacctcaataactatgtattccagggacaacatcctcttactctcaatgagtccaaccctaacacggtggaggtggccgt

SEQ ID NO: 1342 - DNA, 201 bp, Homo sapiens
  misc_feature (1)...(201): n = A,T,C or G, or insertion/deletion polymorphism (see Tables 1-2)
ggtacaagtccttctccgactgtgagccggatgacaaccatctcagcatcgtcaccctggaggaggccccattcgtcatcgtggaagacatagaccccctnaccgagacgtgtgtgaggaacaccgtgccatgtcggaagttcgtcaaaatcaacaattcaaccaatgaggggatgaatgtgaagaaatgctgcaaggggt

SEQ ID NO: 1343 - DNA, 201 bp, Homo sapiens
  misc_feature (1)...(201): n = A,T,C or G, or insertion/deletion polymorphism (see Tables 1-2)
gtttatcttccttcacatccagaaattctgttggacactcacttccaccccaaactcctcaaatcaaaagccttcaaaacacgaggcactcttggatctancctgagtatcctccaaactgtggatacagtttagtgagacaagcaatttctcccttctgagttattctctctgttggtggcaaaccacttcatagcacca

SEQ ID NO: 1344 - DNA, 201 bp, Homo sapiens
cccctaaaggctcagcattaagaaatgctgttaacctggcagtattaaaactgaatgagcaaggcctcttggacaaattgaaaaacaaatggtggtacgayaaaggagagtgcggcagcgggggcggtgactccaaggacaagaccagcgctctgagcctgagcaatgtggcaggcgttttctatatacttgtcggaggtc

SEQ ID NO: 1345 - DNA, 201 bp, Homo sapiens
ttccaaaggctatggtgtggcaacccctaaaggctcagcattaagaaatgctgttaacctggcagtattaaaactgaatgagcaaggcctcttggacaaaytgaaaaacaaatggtggtacgacaaaggagagtgcggcagcgggggcggtgactccaaggacaagaccagcgctctgagcctgagcaatgtggcaggcgt

SEQ ID NO: 1346 - DNA, 201 bp, Homo sapiens
atctggattccaaaggctatggtgtggcaacccctaaaggctcagcattaagaaatgctgttaacctggcagtattaaaactgaatgagcaaggcctcttrgacaaattgaaaaacaaatggtggtacgacaaaggagagtgcggcagcgggggcggtgactccaaggacaagaccagcgctctgagcctgagcaatgtgg

SEQ ID NO: 1347 - DNA, 201 bp, Homo sapiens
atgaaagttggtggaaatctggattccaaaggctatggtgtggcaacccctaaaggctcagcattaagaaatgctgttaacctggcagtattaaaactgartgagcaaggcctcttggacaaattgaaaaacaaatggtggtacgacaaaggagagtgcggcagcgggggcggtgactccaaggacaagaccagcgctctg

SEQ ID NO: 1348 - DNA, 201 bp, Homo sapiens
aagttggtggaaatctggattccaaaggctatggtgtggcaacccctaaaggctcagcattaagaaatgctgttaacctggcagtattaaaactgaatgarcaaggcctcttggacaaattgaaaaacaaatggtggtacgacaaaggagagtgcggcagcgggggcggtgactccaaggacaagaccagcgctctgagcc

SEQ ID NO: 1349 - DNA, 201 bp, Homo sapiens
cagcgaattctttttctttttctattattattttgacgactcctgagttgcgcccatgctcttgtcagcttcgttttaggcgtagcatggccaggcagaaraaaatggggcaaagcgtgctccgggcggtcttctttttagtcctggggcttttgggtcattctcacggaggattccccaacaccatcagcataggtggac

SEQ ID NO: 1350 - DNA, 188 bp, Homo sapiens
agtcacttgaggattttttttccaattcttttctttttgttgttaaagctgtacttcagtgaacagaaaaattgccaagcaaactaatggctataaaagcrtaatttgcatgtgtgggcataaactacagagcctcattgccatgaggtattgtacaaagttttaatacattttgtaaataaaattgt

SEQ ID NO: 1351 - DNA, 201 bp, Homo sapiens
ccttctgtggggccctgcacacatcctttgttacgcctagcttccccactgacgcagatgtgcagtttgtcatccagatgcgcccagccttgaagggcgckattctgagtcttctgggtcattacaagtgggagaagtttgtgtacctctatgacacagaacgaggattttccatcctccaagcgattatggaagcagcag

SEQ ID NO: 1352 - DNA, 201 bp, Homo sapiens
tggaaatctggattccaaaggctatggtgtggcaacccctaaaggctcagcattaagaaatgctgttaacctggcagtattaaaactgaatgagcaaggcmtcttggacaaattgaaaaacaaatggtggtacgacaaaggagagtgcggcagcgggggcggtgactccaaggacaagaccagcgctctgagcctgagcaa

SEQ ID NO: 1353 - DNA, 201 bp, Homo sapiens
gcatggttggggaacttgtctatgggagagctgatatagctgttgctccactcactataacattggtccgtgaagaagtcatagatttttcaaagccattmatgagcctgggcatctccatcatgataaagaagcctcagaaatcaaaaccaggcgtattctcatttctggatcccctggcttatgaaatctggatgtgca

SEQ ID NO: 1354 - DNA, 201 bp, Homo sapiens
aattccctgaagccaagaatgcaccactaaagtatacatctgcattgacacacgacgcaatactggtcatagcagaagctttccgctacctgaggaggcarcgagtagatgtgtcccggagaggaagtgctggagactgcttagcaaatcctgctgtgccctggagtcaaggaattgatattgagagagctctgaaaatgg

SEQ ID NO: 1355 - DNA, 201 bp, Homo sapiens
  misc_feature (1)...(201): n = A,T,C or G, or insertion/deletion polymorphism (see Tables 1-2)
ctggaaatattcaatttgacacttatggacgtaggacaaattataccatcgatgtgtatgaaatgaaagtcagtggctctcgaaaagctggctactggaangagtatgaaaggtttgtgcctttctcagatcagcaaatcagcaatgacagtgcatcctcagagaatcggaccatagtagtgactaccattctggaatcac

SEQ ID NO: 1356 - DNA, 201 bp, Homo sapiens
cgatgaaagttggtggaaatctggattccaaaggctatggtgtggcaacccctaaaggctcagcattaagaaatgctgttaacctggcagtattaaaactsaatgagcaaggcctcttggacaaattgaaaaacaaatggtggtacgacaaaggagagtgcggcagcgggggcggtgactccaaggacaagaccagcgctc

SEQ ID NO: 1357 - DNA, 201 bp, Homo sapiens
attccaaaggctatggtgtggcaacccctaaaggctcagcattaagaaatgctgttaacctggcagtattaaaactgaatgagcaaggcctcttggacaarttgaaaaacaaatggtggtacgacaaaggagagtgcggcagcgggggcggtgactccaaggacaagaccagcgctctgagcctgagcaatgtggcaggcg

SEQ ID NO: 1358 - DNA, 201 bp, Homo sapiens; identical to SEQ ID NO: 1344

SEQ ID NO: 1359 - DNA, 201 bp, Homo sapiens; identical to SEQ ID NO: 1345

SEQ ID NO: 1360 - DNA, 201 bp, Homo sapiens; identical to SEQ ID NO: 1346

SEQ ID NO: 1361 - DNA, 201 bp, Homo sapiens; identical to SEQ ID NO: 1347

SEQ ID NO: 1362 - DNA, 201 bp, Homo sapiens; identical to SEQ ID NO: 1348

SEQ ID NO: 1363 - DNA, 200 bp, Homo sapiens
cgctttggcaaacccagcttgcagccaatgaacccgccttccagattggtgtgaagacagaagtgagcttcgttttaggcgtagcatggccaggcagaaraaaatggggcaaagcgtgctccgggcggtcttctttttagtcctggggcttttgggtcattctcacggaggattccccaacaccatcagcataggtggac

SEQ ID NO: 1364 - DNA, 188 bp, Homo sapiens; identical to SEQ ID NO: 1350

SEQ ID NO: 1365 - DNA, 201 bp, Homo sapiens; identical to SEQ ID NO: 1351

SEQ ID NO: 1366 - DNA, 201 bp, Homo sapiens; identical to SEQ ID NO: 1352

SEQ ID NO: 1367 - DNA, 201 bp, Homo sapiens; identical to SEQ ID NO: 1353

SEQ ID NO: 1368 - DNA, 201 bp, Homo sapiens; identical to SEQ ID NO: 1354

SEQ ID NO: 1369 - DNA, 201 bp, Homo sapiens; identical to SEQ ID NO: 1355
  misc_feature (1)...(201): n = A,T,C or G, or insertion/deletion polymorphism (see Tables 1-2)

SEQ ID NO: 1370 - DNA, 201 bp, Homo sapiens; identical to SEQ ID NO: 1356

SEQ ID NO: 1371 - DNA, 201 bp, Homo sapiens; identical to SEQ ID NO: 1357

SEQ ID NO: 1372 - DNA, 201 bp, Homo sapiens; identical to SEQ ID NO: 1349

SEQ ID NO: 1373 - DNA, 201 bp, Homo sapiens; identical to SEQ ID NO: 1353

SEQ ID NO: 1374 - DNA, 201 bp, Homo sapiens; identical to SEQ ID NO: 1354

SEQ ID NO: 1375 - DNA, 201 bp, Homo sapiens; identical to SEQ ID NO: 1355
  misc_feature (1)...(201): n = A,T,C or G, or insertion/deletion polymorphism (see Tables 1-2)

SEQ ID NO: 1376 - DNA, 188 bp, Homo sapiens; identical to SEQ ID NO: 1350

SEQ ID NO: 1377 - DNA, 201 bp, Homo sapiens; identical to SEQ ID NO: 1351

SEQ ID NO: 1378 - DNA, 179 bp, Homo sapiens
atggagtttcttgggactactcagaccgccagttactgtggtcccaagaaatgctgtggcttgacctcactgccagctrtacaggcgccagtgatccaggaatgctatcagccctactacctgcccgggtaccgctacctcaattcatggaggcctagcctcttctacaagatagccaa

SEQ ID NO: 1379 - DNA, 201 bp, Homo sapiens
agctgacgcaccagatgcaggagggcacctgccggaacctgggccagaggctgtcggacattggcttctggaagtcagagctgagctatgagctggacagscttctgactgagaaccagaacttggagacggtcaagaggcggctggagtgcgcggccaatgaggtgaactgcccattgcaggtggccttggagtgtctgt

SEQ ID NO: 1380 - DNA, 201 bp, Homo sapiens
ggtgaacgaggtgttcaccatcgacgacaccctgcagaccctcaagctgcggctgcgggagacacaggacacgctgcagctgctggtcatgaccaagtgcyggctggagcacgagctcgccatcaaggccaacaccctctgcatcgacaaggagaagtgcatgggcatgcgtaagaccttcccctgcaccccgcgcctggt

SEQ ID NO: 1381 - DNA, 201 bp, Homo sapiens
tcgaagacaaaagctcggcccagtgtatcgatgagaagtgctttaacctgagaaatacgtcagactgcatcagcttcttccacggcatggagaaaattgayggcacgatctccgtacctgagacctgggccaagttcagtaacgacaacatcaaacactctcagaacatgcgggccaactccatccggctgcgggaggagg

SEQ ID NO: 1382 - DNA, 201 bp, Homo sapiens
cctcgaagacaaaagctcggcccagtgtatcgatgagaagtgctttaacctgagaaatacgtcagactgcatcagcttcttccacggcatggagaaaattsacggcacgatctccgtacctgagacctgggccaagttcagtaacgacaacatcaaacactctcagaacatgcgggccaactccatccggctgcgggagga

SEQ ID NO: 1383 - DNA, 201 bp, Homo sapiens
caccatcctgcccacactgcgctccgcactcttctctcgctatagcccccacgactgggaccagtccaaccagctgcaggtgcgtggggccgaggcctccmggctgtgggccagccggctgacggatgactccatgaggctcttgcaggacaaggaccagctgacgcaccagatgcaggagggcacctgccggaacctggg

SEQ ID NO: 1384 - DNA, 201 bp, Homo sapiens
atggagaaaattgacggcacgatctccgtacctgagacctgggccaagttcagtaacgacaacatcaaacactctcagaacatgcgggccaactccatccrgctgcgggaggaggcggagcacctctttgagaccttgtcggatcagatgtggaggcagttcacagacaccaacctggccttcaacgcccgcatctctgag

SEQ ID NO: 1385 - DNA, 201 bp, Homo sapiens
tttaagaattgttcaaatatacaaagatctcctgagaaattgctgcaacacagaaaaccctccaggttgttaccgttacgcggaagacaaattcaatgagwcaactgagaaaagcctcaagatggtacaacaagaatgtaaacatttccagaatttggggaaggatggtttgaaataccattacctcatcaggctcacgaa

SEQ ID NO: 1386 - DNA, 201 bp, Homo sapiens
catccagacctgtctataccagagcttttaagaattgttcaaatatacaaagatctcctgagaaattgctgcaacacagaaaaccctccaggttgttaccrttacgcggaagacaaattcaatgagacaactgagaaaagcctcaagatggtacaacaagaatgtaaacatttccagaatttggggaaggatggtttgaaa

SEQ ID NO: 1387 - DNA, 201 bp, Homo sapiens
gccagaaggaacccatttgtcttcgcccctacacttctaactgttgctgttcattttgaggaggtggccaaatcatgttgtgaagaacaaaacaaagtcawctgccttcaaacaagggcaatacctgtcacacaatatttaaaagcattttcttcttatcaaaaacatgtctgtggggcacttttgaaatttggaaccaaa

SEQ ID NO: 1388 - DNA, 201 bp, Homo sapiens
tgccagaaggaacccatttgtcttcgcccctacacttctaactgttgctgttcattttgaggaggtggccaaatcatgttgtgaagaacaaaacaaagtcwactgccttcaaacaagggcaatacctgtcacacaatatttaaaagcattttcttcttatcaaaaacatgtctgtggggcacttttgaaatttggaaccaa

SEQ ID NO: 1389 - DNA, 179 bp, Homo sapiens
gttacttttttactgataatgtgaaagaatgatataaaaacttgattttcctcaacaacattactttcttttgtaaatrtggtttctacaaagatgaaactactaaaacttacaggttttatttttttcttgttttttttgactgaatccctaaccctgcccacacaacctcgggatat

SEQ ID NO: 1390 - DNA, 201 bp, Homo sapiens
  misc_feature (1)...(201): n = A,T,C or G, or insertion/deletion polymorphism (see Tables 1-2)
ggaaggaacaggagtgtgtttcagcaaacagccttcatccaaaatggaggagccaggcccccgcttcagtcaagacctgcctagaaaaaggaagtggagcnggagcaccgtccagcctccgtgcagccgtggcgtgcaggactcgggtggctctgaggtcgcctggggaccccagaagggacaggctggcctgacatggaa

SEQ ID NO: 1391 - DNA, 201 bp, Homo sapiens
ttaattagattgtttacaaatttaacaggatggctacaaagagatcttattttaaaagcagctgatggtttggaaatgagagaactacagtggtgaagagmccaggaggcagctctcagtgaaaccaacattgcggatgcccttcgtgagccttctcagtcccagcaggaagcccacaacactggcctccccagcctgcct

SEQ ID NO: 1392 - DNA, 201 bp, Homo sapiens
gtcctgggaaggagctatggagtcccatccagcaggttacagccacatcctctaaatgggcgcgatttgtcctgccacctagaaaaagttcacatgtggayagtgagcagccaaggtctcttcagagggaccccaggccagctggtccagcacaggctaagcaagggacccccagagcacaggcctcaagagaaggcctca

SEQ ID NO: 1393 - DNA, 201 bp, Homo sapiens
cttgttaggagggacagggttcccctaaggcacttttaaagatactctgtaagaaccattaacaataaacttactgtcaatcatttctctctatgcaaacrtcattggttaaagtgctgatgccatttaattagattgtttacaaatttaacaggatggctacaaagagatcttattttaaaagcagctgatggtttggaa

SEQ ID NO: 1394 - DNA, 201 bp, Homo sapiens
ggcccctggtcctggaggcacagaatcctcgacccacacgactatgtgacctctttataactggggaagacttcgatgatgatgtgtgatctgggactggyaggttattaatcgagatacacttgttaggagggacagggttcccctaaggcacttttaaagatactctgtaagaaccattaacaataaacttactgtcaa

SEQ ID NO: 1395 - DNA, 190 bp, Homo sapiens
tgcagagcgcacgcgcttggctgcctggcgactgcacaagcagggatggcgtcgcttcagcgttctcgggtgctacgctgctgcagctgycgcctcttccaggcgcaccaggtaaaaaagagtgtcaagtggacatgcaaagcttgtggagagaagcagtcctttttgcgggcttatggtgaaggctctg

SEQ ID NO: 1396 - DNA, 201 bp, Homo sapiens
agccaggcccccgcttcagtcaagacctgcctagaaaaaggaagtggagcgggagcaccgtccagcctccgtgcagccgtggcgtgcaggactcgggtggytctgaggtcgcctggggaccccagaagggacaggctggcctgacatggaaggtgaaacaaggcagcagcccctgcctccaggagaactctgcagactgca

SEQ ID NO: 1397 - DNA, 201 bp, Homo sapiens
  misc_feature (1)...(201): n = A,T,C or G, or insertion/deletion polymorphism (see Tables 1-2)
gagaactctgcagactgcagtgccggggagctgaggggtcctgggaaggagctatggagtcccatccagcaggttacagccacatcctctaaatgggcgcnatttgtcctgccacctagaaaaagttcacatgtggacagtgagcagccaaggtctcttcagagggaccccaggccagctggtccagcacaggctaagcaa

SEQ ID NO: 1398 - DNA, 201 bp, Homo sapiens
aagaagaaaacgtgggacaccagcaggctgggaatgtgaagcagcaggaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaa

SEQ ID NO: 1399 - DNA, 201 bp, Homo sapiens
atttaattagattgtttacaaatttaacaggatggctacaaagagatcttattttaaaagcagctgatggtttggaaatgagagaactacagtggtgaagrgaccaggaggcagctctcagtgaaaccaacattgcggatgcccttcgtgagccttctcagtcccagcaggaagcccacaacactggcctccccagcctgc

SEQ ID NO: 1400 - DNA, 201 bp, Homo sapiens
ccagcaggttacagccacatcctctaaatgggcgcgatttgtcctgccacctagaaaaagttcacatgtggacagtgagcagccaaggtctcttcagaggraccccaggccagctggtccagcacaggctaagcaagggacccccagagcacaggcctcaagagaaggcctcagcaggcccactgccgctgtccagcttcc

SEQ ID NO: 1401 - DNA, 201 bp, Homo sapiens
tggttaaagtgctgatgccatttaattagattgtttacaaatttaacaggatggctacaaagagatcttattttaaaagcagctgatggtttggaaatgaragaactacagtggtgaagagaccaggaggcagctctcagtgaaaccaacattgcggatgcccttcgtgagccttctcagtcccagcaggaagcccacaac

SEQ ID NO: 1402 - DNA, 201 bp, Homo sapiens; identical to SEQ ID NO: 1390
  misc_feature (1)...(201): n = A,T,C or G, or insertion/deletion polymorphism (see Tables 1-2)

SEQ ID NO: 1403 - DNA, 201 bp, Homo sapiens; identical to SEQ ID NO: 1391

SEQ ID NO: 1404 - DNA, 201 bp, Homo sapiens; identical to SEQ ID NO: 1392

SEQ ID NO: 1405 - DNA, 201 bp, Homo sapiens; identical to SEQ ID NO: 1393

SEQ ID NO: 1406 - DNA, 201 bp, Homo sapiens; identical to SEQ ID NO: 1394

SEQ ID NO: 1407 - DNA, 201 bp, Homo sapiens; identical to SEQ ID NO: 1396

SEQ ID NO: 1408 - DNA, 201 bp, Homo sapiens; identical to SEQ ID NO: 1397
  misc_feature (1)...(201): n = A,T,C or G, or insertion/deletion polymorphism (see Tables 1-2)

SEQ ID NO: 1409 - DNA, 190 bp, Homo sapiens; identical to SEQ ID NO: 1395

SEQ ID NO: 1410 - DNA, 201 bp, Homo sapiens
caaaagttaaatctactacagggacaagtttcagagctgccactcaggaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaa

SEQ ID NO: 1411 - DNA, 201 bp, Homo sapiens; identical to SEQ ID NO: 1400

SEQ ID NO: 1412 - DNA, 201 bp, Homo sapiens; identical to SEQ ID NO: 1399

SEQ ID NO: 1413 - DNA, 201 bp, Homo sapiens; identical to SEQ ID NO: 1401

SEQ ID NO: 1414 - DNA, 201 bp, Homo sapiens; identical to SEQ ID NO: 1390
  misc_feature (1)...(201): n = A,T,C or G, or insertion/deletion polymorphism (see Tables 1-2)

SEQ ID NO: 1415 - DNA, 201 bp, Homo sapiens; identical to SEQ ID NO: 1391

SEQ ID NO: 1416 - DNA, 201 bp, Homo sapiens; identical to SEQ ID NO: 1392

SEQ ID NO: 1417 - DNA, 201 bp, Homo sapiens; identical to SEQ ID NO: 1393

SEQ ID NO: 1418 - DNA, 201 bp, Homo sapiens; identical to SEQ ID NO: 1394

SEQ ID NO: 1419 - DNA, 201 bp, Homo sapiens; identical to SEQ ID NO: 1396

SEQ ID NO: 1420 - DNA, 201 bp, Homo sapiens; identical to SEQ ID NO: 1397
  misc_feature (1)...(201): n = A,T,C or G, or insertion/deletion polymorphism (see Tables 1-2)

SEQ ID NO: 1421 - DNA, 154 bp, Homo sapiens
gaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaa

SEQ ID NO: 1422 - DNA, 201 bp, Homo sapiens; identical to SEQ ID NO: 1400

SEQ ID NO: 1423 - DNA, 201 bp, Homo sapiens; identical to SEQ ID NO: 1399

SEQ ID NO: 1424 - DNA, 201 bp, Homo sapiens; identical to SEQ ID NO: 1401

SEQ ID NO: 1425 - DNA, 201 bp, Homo sapiens; identical to SEQ ID NO: 1392

SEQ ID NO: 1426 - DNA, 201 bp, Homo sapiens; identical to SEQ ID NO: 1390
  misc_feature (1)...(201): n = A,T,C or G, or insertion/deletion polymorphism (see Tables 1-2)

SEQ ID NO: 1427 - DNA, 201 bp, Homo sapiens
agccaggcccccgcttcagtcaagacctgcctagaaaaaggaagtggagcgggagcaccgtccagcctccgtgcagccgtggcgtgcaggactcgggtggytctgaggtcgcctggggaccccagaagggacaggctggcctgacatggaaggtgaaacaagcagcagcccctgccttcaggagaactctgcagactgcag

SEQ ID NO: 1428 - DNA, 201 bp, Homo sapiens; identical to SEQ ID NO: 1400

SEQ ID NO: 1429 - DNA, 201 bp, Homo sapiens; identical to SEQ ID NO: 1394

SEQ ID NO: 1430 - DNA, 201 bp, Homo sapiens; identical to SEQ ID NO: 1397
  misc_feature (1)...(201): n = A,T,C or G, or insertion/deletion polymorphism (see Tables 1-2)

SEQ ID NO: 1431 - DNA, 201 bp, Homo sapiens
aggcaggctggggaggccagtgttgtgggcttcctgctgggactgagaaggctcacgaagggcatccgcaatgttggtttcactgagagctgcctcctggkctcttcaccactgtagttctctcatttccaaaccatcagctgcttttaaaataagatctctttgtagccatcctgttaaatttgtaaacaatctaattaa

SEQ ID NO: 1432 - DNA, 201 bp, Homo sapiens
  misc_feature (1)...(201): n = A,T,C or G, or insertion/deletion polymorphism (see Tables 1-2)
cagtctgcagagttctcctggaggcaggggctgctgccttgtttcaccttccatgtcaggccagcctgtccctgaaagagaagatggccatgccctccatntgtaagaacaatgccagggcccaggaggaccgcctgccctgcctgggccttggctgggcctctggttctgacactttctgctggaagctgtcaggctggg

SEQ ID NO: 1433 - DNA, 201 bp, Homo sapiens
ttgacagtaagtttattgttaatggttcttacagagtatctttaaaagtgccttaggggaaccctgtccctcctaacaagtgtatctcgattaataacctrccagtcccagatcacacatcatcatcgaagtcttccccagttataaagaggtcacatagtcgtgtgggtcgaggattctgtgcctccaggaccaggggcc

SEQ ID NO: 1434 - DNA, 201 bp, Homo sapiens
  misc_feature (1)...(201): n = A,T,C or G, or insertion/deletion polymorphism (see Tables 1-2)
ttgcttagcctgtgctggaccagctggcctggggtccctctgaagagaccttggctgctcactgtccacatgtgaactttttctaggtggcaggacaaatngcgcccatttagaggatgtggctgtaacctgctggatgggactccatagctccttcccaggacccctcagctccccggcactgcagtctgcagagttctc

SEQ ID NO: 1435 - DNA, 201 bp, Homo sapiens
  misc_feature (1)...(201): n = A,T,C or G, or insertion/deletion polymorphism (see Tables 1-2)
catcccccgccgttgtgaccacttttgcccacctcttctgcgtgcccctcttctgtctcatagttgtgttaagcttgcgtagaattgcaggtctctgtacnggccagtttctctgccttcttccaggatcaggggttagggtgcaagaagccatttagggcagcaaaacaagtgacatgaagggagggtccctgtgtgtgt

SEQ ID NO: 1436 - DNA, 201 bp, Homo sapiens
ggaagctggacagcggcagtgggcctgctgaggccttctcttgaggcctgtgctctgggggtcccttgcttagcctgtgctggaccagctggcctggggtycctctgaagagaccttggctgctcactgtccacatgtgaactttttctaggtggcaggacaaatcgcgcccatttagaggatgtggctgtaacctgctgg

SEQ ID NO: 1437 - DNA, 201 bp, Homo sapiens
gcaggctggggaggccagtgttgtgggcttcctgctgggactgagaaggctcacgaagggcatccgcaatgttggtttcactgagagctgcctcctggtcycttcaccactgtagttctctcatttccaaaccatcagctgcttttaaaataagatctctttgtagccatcctgttaaatttgtaaacaatctaattaaat

SEQ ID NO: 1438 - DNA, 201 bp, Homo sapiens
gttgtgggcttcctgctgggactgagaaggctcacgaagggcatccgcaatgttggtttcactgagagctgcctcctggtctcttcaccactgtagttctytcatttccaaaccatcagctgcttttaaaataagatctctttgtagccatcctgttaaatttgtaaacaatctaattaaatggcatcagcactttaacca

SEQ ID NO: 1439 - DNA, 201 bp, Homo sapiens
tgaggccttctcttgaggcctgtgctctgggggtcccttgcttagcctgtgctggaccagctggcctggggtccctctgaagagaccttggctgctcactrtccacatgtgaactttttctaggtggcaggacaaatcgcgcccatttagaggatgtggctgtaacctgctggatgggactccatagctccttcccaggac

SEQ ID NO: 1440 - DNA, 201 bp, Homo sapiens
ttccaaaccatcagctgcttttaaaataagatctctttgtagccatcctgttaaatttgtaaacaatctaattaaatggcatcagcactttaaccaatgaygtttgcatagagagaaatgattgacagtaagtttattgttaatggttcttacagagtatctttaaaagtgccttaggggaaccctgtccctcctaacaag

SEQ ID NO: 1441 - DNA, 201 bp, Homo sapiens
cccccgtctctccagagagttccagcacagaggagaagagcagctcacagccaagcagctgctgctctgatcccagcaagccgggtgggaatgttgagggygccacgcagtctctggcggagcagatgagaaagatcgccttggagtccgaggggcgccctgaggaacagatggagtcggataactgttcaggaggagatg

SEQ ID NO: 1442 - DNA, 201 bp, Homo sapiens
agccaagcagctgctgctctgatcccagcaagccgggtgggaatgttgagggcgccacgcagtctctggcggagcagatgagaaagatcgccttggagtcygaggggcgccctgaggaacagatggagtcggataactgttcaggaggagatgatgactggacccatctgtcttcaaaagaagtggacccgtctacaggtg

SEQ ID NO: 1443 - DNA, 201 bp, Homo sapiens
gccaagcagctgctgctctgatcccagcaagccgggtgggaatgttgagggcgccacgcagtctctggcggagcagatgagaaagatcgccttggagtccraggggcgccctgaggaacagatggagtcggataactgttcaggaggagatgatgactggacccatctgtcttcaaaagaagtggacccgtctacaggtga

SEQ ID NO: 1444 - DNA, 201 bp, Homo sapiens
gggagagtgtggcagctgcccttagccctctgggcattgaagttgatatcgatgtggagcacggagggaaaagaagccgcctgacccccgtctctccagasagttccagcacagaggagaagagcagctcacagccaagcagctgctgctctgatcccagcaagccgggtgggaatgttgagggcgccacgcagtctctgg

SEQ ID NO: 1445 - DNA, 201 bp, Homo sapiens
atgtgatctgcgatggctgcaatgggcctgtggtaggaacccgctacaagtgcagcgtctgcccagactacgacttgtgtagcgtctgcgagggaaagggyttgcaccgggggcacaccaagctcgcattccccagccccttcgggcacctgtctgagggcttctcgcacagccgctggctccggaaggtgaaacacggac

SEQ ID NO: 1446 - DNA, 201 bp, Homo sapiens
  misc_feature (1)...(201): n = A,T,C or G, or insertion/deletion polymorphism (see Tables 1-2)
aggagaagagcagctcacagccaagcagctgctgctctgatcccagcaagccgggtgggaatgttgagggcgccacgcagtctctggcggagcagatgagnaagatcgccttggagtccgaggggcgccctgaggaacagatggagtcggataactgttcaggaggagatgatgactggacccatctgtcttcaaaagaag

SEQ ID NO: 1447 - DNA, 201 bp, Homo sapiens
  misc_feature (1)...(201): n = A,T,C or G, or insertion/deletion polymorphism (see Tables 1-2)
tggagcacggagggaaaagaagccgcctgacccccgtctctccagagagttccagcacagaggagaagagcagctcacagccaagcagctgctgctctgancccagcaagccgggtgggaatgttgagggcgccacgcagtctctggcggagcagatgagaaagatcgccttggagtccgaggggcgccctgaggaacaga

SEQ ID NO: 1448 - DNA, 201 bp, Homo sapiens; identical to SEQ ID NO: 1431

SEQ ID NO: 1449 - DNA, 201 bp, Homo sapiens; identical to SEQ ID NO: 1432
  misc_feature (1)...(201): n = A,T,C or G, or insertion/deletion polymorphism (see Tables 1-2)

SEQ ID NO: 1450 - DNA, 201 bp, Homo sapiens; identical to SEQ ID NO: 1433

SEQ ID NO: 1451 - DNA, 201 bp, Homo sapiens; identical to SEQ ID NO: 1434
  misc_feature (1)...(201): n = A,T,C or G, or insertion/deletion polymorphism (see Tables 1-2)

SEQ ID NO: 1452 - DNA, 201 bp, Homo sapiens; identical to SEQ ID NO: 1435
  misc_feature (1)...(201): n = A,T,C or G, or insertion/deletion polymorphism (see Tables 1-2)

SEQ ID NO: 1453 - DNA, 201 bp, Homo sapiens; identical to SEQ ID NO: 1436

SEQ ID NO: 1454 - DNA, 201 bp, Homo sapiens; identical to SEQ ID NO: 1437

SEQ ID NO: 1455 - DNA, 201 bp, Homo sapiens; identical to SEQ ID NO: 1438

SEQ ID NO: 1456 - DNA, 201 bp, Homo sapiens; identical to SEQ ID NO: 1439

SEQ ID NO: 1457 - DNA, 201 bp, Homo sapiens; identical to SEQ ID NO: 1440

SEQ ID NO: 1458 - DNA, 201 bp, Homo sapiens; identical to SEQ ID NO: 1441

SEQ ID NO: 1459 - DNA, 201 bp, Homo sapiens; identical to SEQ ID NO: 1442

SEQ ID NO: 1460 - DNA, 201 bp, Homo sapiens; identical to SEQ ID NO: 1443

SEQ ID NO: 1461 - DNA, 201 bp, Homo sapiens; identical to SEQ ID NO: 1444

SEQ ID NO: 1462 - DNA, 201 bp, Homo sapiens; identical to SEQ ID NO: 1445

SEQ ID NO: 1463 - DNA, 201 bp, Homo sapiens; identical to SEQ ID NO: 1446
  misc_feature (1)...(201): n = A,T,C or G, or insertion/deletion polymorphism (see Tables 1-2)

SEQ ID NO: 1464 - DNA, 201 bp, Homo sapiens; identical to SEQ ID NO: 1447
  misc_feature (1)...(201): n = A,T,C or G, or insertion/deletion polymorphism (see Tables 1-2)

SEQ ID NO: 1465 - DNA, 201 bp, Homo sapiens
gcaggctggggaggccagtgttgtgggcttcctgctgggactgagaaggctcacgaagggcatccgcaatgttggtttcactgagagctgcctcctggtcrcttcaccactgtagttctctcatttccaaaccatcagctgcttttaaaataagatctctttgtagccatcctgttaaatttgtaaacaatctaattaaat

SEQ ID NO: 1466 - DNA, 201 bp, Homo sapiens
gttgtgggcttcctgctgggactgagaaggctcacgaagggcatccgcaatgttggtttcactgagagctgcctcctggtctcttcaccactgtagttctrtcatttccaaaccatcagctgcttttaaaataagatctctttgtagccatcctgttaaatttgtaaacaatctaattaaatggcatcagcactttaacca

SEQ ID NO: 1467 - DNA, 201 bp, Homo sapiens; identical to SEQ ID NO: 1446
  misc_feature (1)...(201): n = A,T,C or G, or insertion/deletion polymorphism (see Tables 1-2)

SEQ ID NO: 1468 - DNA, 201 bp, Homo sapiens; identical to SEQ ID NO: 1447
  misc_feature (1)...(201): n = A,T,C or G, or insertion/deletion polymorphism (see Tables 1-2)

SEQ ID NO: 1469 - DNA, 201 bp, Homo sapiens
tgaggccttctcttgaggcctgtgctctgggggtcccttgcttagcctgtgctggaccagctggcctggggtccctctgaagagaccttggctgctcactytccacatgtgaactttttctaggtggcaggacaaatcgcgcccatttagaggatgtggctgtaacctgctggatgggactccatagctccttcccaggac

SEQ ID NO: 1470 - DNA, 201 bp, Homo sapiens
ggaagctggacagcggcagtgggcctgctgaggccttctcttgaggcctgtgctctgggggtcccttgcttagcctgtgctggaccagctggcctggggtrcctctgaagagaccttggctgctcactgtccacatgtgaactttttctaggtggcaggacaaatcgcgcccatttagaggatgtggctgtaacctgctgg

SEQ ID NO: 1471 - DNA, 201 bp, Homo sapiens
aggcaggctggggaggccagtgttgtgggcttcctgctgggactgagaaggctcacgaagggcatccgcaatgttggtttcactgagagctgcctcctggmctcttcaccactgtagttctctcatttccaaaccatcagctgcttttaaaataagatctctttgtagccatcctgttaaatttgtaaacaatctaattaa

SEQ ID NO: 1472 - DNA, 201 bp, Homo sapiens
ttgacagtaagtttattgttaatggttcttacagagtatctttaaaagtgccttaggggaaccctgtccctcctaacaagtgtatctcgattaataacctyccagtcccagatcacacatcatcatcgaagtcttccccagttataaagaggtcacatagtcgtgtgggtcgaggattctgtgcctccaggaccaggggcc

SEQ ID NO: 1473 - DNA, 201 bp, Homo sapiens; identical to SEQ ID NO: 1432
  misc_feature (1)...(201): n = A,T,C or G, or insertion/deletion polymorphism (see Tables 1-2)

SEQ ID NO: 1474 - DNA, 201 bp, Homo sapiens; identical to SEQ ID NO: 1434
  misc_feature (1)...(201): n = A,T,C or G, or insertion/deletion polymorphism (see Tables 1-2)

SEQ ID NO: 1475 - DNA, 201 bp, Homo sapiens; identical to SEQ ID NO: 1435
  misc_feature (1)...(201): n = A,T,C or G, or insertion/deletion polymorphism (see Tables 1-2)

SEQ ID NO: 1476 - DNA, 201 bp, Homo sapiens; identical to SEQ ID NO: 1445

SEQ ID NO: 1477 - DNA, 201 bp, Homo sapiens; identical to SEQ ID NO: 1444

SEQ ID NO: 1478 - DNA, 201 bp, Homo sapiens; identical to SEQ ID NO: 1441

SEQ ID NO: 1479 - DNA, 201 bp, Homo sapiens; identical to SEQ ID NO: 1442

SEQ ID NO: 1480 - DNA, 201 bp, Homo sapiens; identical to SEQ ID NO: 1443

SEQ ID NO: 1481 - DNA, 201 bp, Homo sapiens
ttccaaaccatcagctgcttttaaaataagatctctttgtagccatcctgttaaatttgtaaacaatctaattaaatggcatcagcactttaaccaatgargtttgcatagagagaaatgattgacagtaagtttattgttaatggttcttacagagtatctttaaaagtgccttaggggaaccctgtccctcctaacaag

SEQ ID NO: 1482 - DNA, 143 bp, Homo sapiens
  misc_feature (1)...(143): n = A,T,C or G, or insertion/deletion polymorphism (see Tables 1-2)
gcgggtgtttgtcgcttcgcggggccttgcggcagcatggcgnaccatctgatcagtggcggcaccggctacgtgccccaggactggctcaccgtgcagcagctcttcctcggcgccaactgccgcacccacaacaacttcct

SEQ ID NO: 1483 - DNA, 201 bp, Homo sapiens
tacctccacctccaggtgattgggaggaatgtggtgacagcagcccaggctaagaacctgattgacactggtgtggatggactgcatgtagttatgggctrcagctctatctgcatcacccaggaagtgatggcctgcggtcagccccagggcactgctgtgtacaaggtggccaagtacgctcagcactttggtgtgtcc

SEQ ID NO: 1484 - DNA, 201 bp, Homo sapiens
aggtagacctaacttcagccctgacccggaagatcatgctgaagacaccactgatctcttcccctatggacactgagacagaggccgacatggccatcgcratggctctgatgggaggtattggtttcattcaccacaactgcaccccagagttccaggccaacgaggtgcataaggtcaagaagtttgaacagggcttca

SEQ ID NO: 1485 - DNA, 201 bp, Homo sapiens
tgtggcatccagaccgtggggcacgtggtcaaggccctggcccttggagcctccacagtgatgatgggctccctgctggccaccaccacggaggcccagcrgcgagtacttcttctcagacagggtgcagctcaagaagtactggggcatgggctcgctagatgccatggagaagagcagcagcagccagaaacgatactt

SEQ ID NO: 1486 - DNA, 201 bp, Homo sapiens
ccgtggtgctgagcccctcacacactgtgggtgatgtgctggaggccaagatccggcatggcttctcttgcatcctcatcactgagatgggcaccatgggsagcaagttggtgggcatcatctcctcccgagacatcaactttcttgctgagaaggaccacaccaccctcctcagtgaggtgatgacgccaaggatcaagc

SEQ ID NO: 1487 - DNA, 186 bp, Homo sapiens
gtgcagggtgtctcggcctccatccaggacaaagggtccattcagaagtttgtgccctacctcatagcgagtaaccagcatggctccatgatgtactcagragagctcaaatttgagaagtggaccatgtcagcccagatcgagggtggcgtccatggcctgcacgcttaccagaagcagctgtac

SEQ ID NO: 1488 - DNA, 201 bp, Homo sapiens
catcaactttcttgctgagaaggaccacaccaccctcctcagtgaggtgatgacgccaaggatcaagctgatggtggctccagcaggcatgacattgaaasaggcaaatgagatccttcagcctagcaagggaagctgcctatggtcaatgatcgccatgagctagtggccatcgtctcccacaccaacctgaagaagaat

SEQ ID NO: 1489 - DNA, 201 bp, Homo sapiens
gtgaggtgatgacgccaaggatcaagctgatggtggctccagcaggcatgacattgaaacaggcaaatgagatccttcagcctagcaagggaagctgcctytggtcaatgatcgccatgagctagtggccatcgtctcccacaccaacctgaagaagaatcgagactacattctggcctccaaggattcccacaagcagct

SEQ ID NO: 1490 - DNA, 201 bp, Homo sapiens
gcctagcaagggaagctgcctatggtcaatgatcgccatgagctagtggccatcgtctcccacaccaacctgaagaagaatcgagactacattctggcctycaaggattcccacaagcagctgctgtgcagggcagctgtgggcacccatgaggatgacaaatactgcctggacctgctcacctgggtaggcatcaacgtc

SEQ ID NO: 1491 - DNA, 201 bp, Homo sapiens
accaccctcctcagtgaggtgatgacgccaaggatcaagctgatggtggctccagcaggcatgacattgaaacaggcaaatgagatccttcagcctagcargggaagctgcctatggtcaatgatcgccatgagctagtggccatcgtctcccacaccaacctgaagaagaatcgagactacattctggcctccaaggatt

SEQ ID NO: 1492 - DNA, 201 bp, Homo sapiens
cccacaccaacctgaagaagaatcgagactacattctggcctccaaggattcccacaagcagctgctgtgcagggcagctgtgggcacccatgaggatgamaaatactgcctggacctgctcacctgggtaggcatcaacgtcatagtcttggactcctcccaagggaactcggtgtatcaaatcaccatggtgcattaca

SEQ ID NO: 1493 - DNA, 201 bp, Homo sapiens
gtgtatcaaatcaccatggtgcattacatcaaacagaagtacctccacctccaggtgattgggaggaatgtggtgacagcagcccaggctaagaacctgaytgacactggtgtggatggactgcatgtagttatgggctgcagctctatctgcatcacccaggaagtgatggcctgcggtcagccccagggcactgctgtg

SEQ ID NO: 1494 - DNA, 201 bp, Homo sapiens
ttgtggagaccagaccagcaggagatagaaccttccagaagtgggcagctgtggtggtgccttctggagaagagcagagatacacatgccatgtacagcaygaggggctgccgaagcccctcaccctgagatgggagccgtcttcccagtccaccgtccccatcgtgggcattgttgctggcctggctgtcctagcagttg

SEQ ID NO: 1495 - DNA, 201 bp, Homo sapiens
cctccgcgggtatgaccaggacgcctacgacggcaaggattacatcgccctgaacgaggacctgagctcctggaccgcggcggacaccgcggctcagatcwcccagcgcaagtgggaggcggcccgtgtggcggagcagcagagagcctacctggagggcacgtgcgtggagtggctccgcagatacctggagaacgggaa

SEQ ID NO: 1496 - DNA, 201 bp, Homo sapiens
cggacgggcgcctcctccgcgggtatgaccaggacgcctacgacggcaaggattacatcgccctgaacgaggacctgagctcctggaccgcggcggacacsgcggctcagatcacccagcgcaagtgggaggcggcccgtgtggcggagcagcagagagcctacctggagggcacgtgcgtggagtggctccgcagatacc

SEQ ID NO: 1497 - DNA, 201 bp, Homo sapiens
acgtggggccggacgggcgcctcctccgcgggtatgaccaggacgcctacgacggcaaggattacatcgccctgaacgaggacctgagctcctggaccgcsgcggacaccgcggctcagatcacccagcgcaagtgggaggcggcccgtgtggcggagcagcagagagcctacctggagggcacgtgcgtggagtggctcc

SEQ ID NO: 1498 - DNA, 201 bp, Homo sapiens
gatgtacggctgcgacgtggggccggacgggcgcctcctccgcgggtatgaccaggacgcctacgacggcaaggattacatcgccctgaacgaggacctgmgctcctggaccgcggcggacaccgcggctcagatcacccagcgcaagtgggaggcggcccgtgtggcggagcagcagagagcctacctggagggcacgtg

SEQ ID NO: 1499 - DNA, 201 bp, Homo sapiens
gcgaggccgggtctcacatcatccagaggatgtacggctgcgacgtggggccggacgggcgcctcctccgcgggtatgaccaggacgcctacgacggcaargattacatcgccctgaacgaggacctgagctcctggaccgcggcggacaccgcggctcagatcacccagcgcaagtgggaggcggcccgtgtggcggagc

SEQ ID NO: 1500 - DNA, 201 bp, Homo sapiens
cgctactacaaccagagcgaggccgggtctcacatcatccagaggatgtacggctgcgacgtggggccggacgggcgcctcctccgcgggtatgaccagghcgcctacgacggcaaggattacatcgccctgaacgaggacctgagctcctggaccgcggcggacaccgcggctcagatcacccagcgcaagtgggaggcg

SEQ ID NO: 1501 - DNA, 201 bp, Homo sapiens
cgcgctccgctactacaaccagagcgaggccgggtctcacatcatccagaggatgtacggctgcgacgtggggccggacgggcgcctcctccgcgggtatvaccaggacgcctacgacggcaaggattacatcgccctgaacgaggacctgagctcctggaccgcggcggacaccgcggctcagatcacccagcgcaagtg

SEQ ID NO: 1502 - DNA, 201 bp, Homo sapiens
ccgcgctccgctactacaaccagagcgaggccgggtctcacatcatccagaggatgtacggctgcgacgtggggccggacgggcgcctcctccgcgggtaygaccaggacgcctacgacggcaaggattacatcgccctgaacgaggacctgagctcctggaccgcggcggacaccgcggctcagatcacccagcgcaagt

SEQ ID NO: 1503 - DNA, 201 bp, Homo sapiens
caccgcgctccgctactacaaccagagcgaggccgggtctcacatcatccagaggatgtacggctgcgacgtggggccggacgggcgcctcctccgcgggyatgaccaggacgcctacgacggcaaggattacatcgccctgaacgaggacctgagctcctggaccgcggcggacaccgcggctcagatcacccagcgcaa

SEQ ID NO: 1504 - DNA, 201 bp, Homo sapiens
cctgagatgggagccgtcttcccagtccaccgtccccatcgtgggcattgttgctggcctggctgtcctagcagttgtggtcatcggagctgtggtcgctrctgtgatgtgtaggaggaagagctcaggtggaaaaggagggagctactctcaggctgcgtgcagcgacagtgcccagggctctgatgtgtctctcacagc

SEQ ID NO: 1505 - DNA, 201 bp, Homo sapiens
gctgccgaagcccctcaccctgagatgggagccgtcttcccagtccaccgtccccatcgtgggcattgttgctggcctggctgtcctagcagttgtggtcrtcggagctgtggtcgctgctgtgatgtgtaggaggaagagctcaggtggaaaaggagggagctactctcaggctgcgtgcagcgacagtgcccagggctc

SEQ ID NO: 1506 - DNA, 201 bp, Homo sapiens
ggctgccgaagcccctcaccctgagatgggagccgtcttcccagtccaccgtccccatcgtgggcattgttgctggcctggctgtcctagcagttgtggtyatcggagctgtggtcgctgctgtgatgtgtaggaggaagagctcaggtggaaaaggagggagctactctcaggctgcgtgcagcgacagtgcccagggct

SEQ ID NO: 1507 - DNA, 201 bp, Homo sapiens
gcatgaggggctgccgaagcccctcaccctgagatgggagccgtcttcccagtccaccgtccccatcgtgggcattgttgctggcctggctgtcctagcarttgtggtcatcggagctgtggtcgctgctgtgatgtgtaggaggaagagctcaggtggaaaaggagggagctactctcaggctgcgtgcagcgacagtgc

SEQ ID NO: 1508 - DNA, 201 bp, Homo sapiens
agcatgaggggctgccgaagcccctcaccctgagatgggagccgtcttcccagtccaccgtccccatcgtgggcattgttgctggcctggctgtcctagcmgttgtggtcatcggagctgtggtcgctgctgtgatgtgtaggaggaagagctcaggtggaaaaggagggagctactctcaggctgcgtgcagcgacagtg

SEQ ID NO: 1509 - DNA, 201 bp, Homo sapiens
agcagagagcctacctggagggcacgtgcgtggagtggctccgcagatacctggagaacgggaaggagacgctgcagcgcgcggaccccccaaagacacaygtgacccaccaccccatctctgaccatgaggccaccctgaggtgctgggccctgggcttctaccctgcggagatcacactgacctggcagcgggatggcg

SEQ ID NO: 1510 - DNA, 201 bp, Homo sapiens
cagcatgaggggctgccgaagcccctcaccctgagatgggagccgtcttcccagtccaccgtccccatcgtgggcattgttgctggcctggctgtcctagyagttgtggtcatcggagctgtggtcgctgctgtgatgtgtaggaggaagagctcaggtggaaaaggagggagctactctcaggctgcgtgcagcgacagt

SEQ ID NO: 1511 - DNA, 201 bp, Homo sapiens
ggagggcacgtgcgtggagtggctccgcagatacctggagaacgggaaggagacgctgcagcgcgcggaccccccaaagacacacgtgacccaccaccccrtctctgaccatgaggccaccctgaggtgctgggccctgggcttctaccctgcggagatcacactgacctggcagcgggatggcgaggaccaaactcagga

SEQ ID NO: 1512 - DNA, 201 bp, Homo sapiens
ctgagcttgtggagaccagaccagcaggagatagaaccttccagaagtgggcagctgtggtggtgccttctggagaagagcagagatacacatgccatgtrcagcatgaggggctgccgaagcccctcaccctgagatgggagccgtcttcccagtccaccgtccccatcgtgggcattgttgctggcctggctgtcctag

SEQ ID NO: 1513 - DNA, 201 bp, Homo sapiens
ggtcacggcgccccgaaccgtcctcctgctgctctggggggcagtggccctgaccgagacctgggccggctcccactccatgaggtatttctacaccgccrtgtcccggcccggccgcggggagccccgcttcatcaccgtgggctacgtggacgacacccagttcgtgaggttcgacagcgacgccacgagtccgaggat

SEQ ID NO: 1514 - DNA, 201 bp, Homo sapiens
agacgccgagatgcgggtcacggcgccccgaaccgtcctcctgctgctctggggggcagtggccctgaccgagacctgggccggctcccactccatgaggyatttctacaccgccatgtcccggcccggccgcggggagccccgcttcatcaccgtgggctacgtggacgacacccagttcgtgaggttcgacagcgacgc

SEQ ID NO: 1515 - DNA, 201 bp, Homo sapiens
ctgagatgcaggatttcttcacgcctcccctttgtgacttcaagagcctctggcatctctttctgcaaaggcacctgaatgtgtctgcgtccctgttagcmtaatgtgaggaggtggagagacagcccacccttgtgtccactgtgacccctgttcccatgctgacctgtgtttcctccccagtcatctttcttgttccag

SEQ ID NO: 1516 - DNA, 201 bp, Homo sapiens
ttgtgagggactgagatgcaggatttcttcacgcctcccctttgtgacttcaagagcctctggcatctctttctgcaaaggcacctgaatgtgtctgcgtycctgttagcataatgtgaggaggtggagagacagcccacccttgtgtccactgtgacccctgttcccatgctgacctgtgtttcctccccagtcatcttt

SEQ ID NO: 1517 - DNA, 201 bp, Homo sapiens
gctctgatgtgtctctcacagcttgaaaagcctgagacagctgtcttgtgagggactgagatgcaggatttcttcacgcctcccctttgtgacttcaagascctctggcatctctttctgcaaaggcacctgaatgtgtctgcgtccctgttagcataatgtgaggaggtggagagacagcccacccttgtgtccactgtg

SEQ ID NO: 1518 - DNA, 201 bp, Homo sapiens
ctcaggacactgagcttgtggagaccagaccagcaggagatagaaccttccagaagtgggcagctgtggtggtgccttctggagaagagcagagatacacrtgccatgtacagcatgaggggctgccgaagcccctcaccctgagatgggagccgtcttcccagtccaccgtccccatcgtgggcattgttgctggcctgg

SEQ ID NO: 1519 - DNA, 201 bp, Homo sapiens
gcgaggaccaaactcaggacactgagcttgtggagaccagaccagcaggagatagaaccttccagaagtgggcagctgtggtggtgccttctggagaagarcagagatacacatgccatgtacagcatgaggggctgccgaagcccctcaccctgagatgggagccgtcttcccagtccaccgtccccatcgtgggcattg

SEQ ID NO: 1520 - DNA, 201 bp, Homo sapiens
tgcgtgcagcgacagtgcccagggctctgatgtgtctctcacagcttgaaaagcctgagacagctgtcttgtgagggactgagatgcaggatttcttcackcctcccctttgtgacttcaagagcctctggcatctctttctgcaaaggcacctgaatgtgtctgcgtccctgttagcataatgtgaggaggtggagagac

SEQ ID NO: 1521 - DNA, 201 bp, Homo sapiens
ggatggcgaggaccaaactcaggacactgagcttgtggagaccagaccagcaggagatagaaccttccagaagtgggcagctgtggtggtgccttctggasaagagcagagatacacatgccatgtacagcatgaggggctgccgaagcccctcaccctgagatgggagccgtcttcccagtccaccgtccccatcgtggg

SEQ ID NO: 1522 - DNA, 201 bp, Homo sapiens
aggagggagctactctcaggctgcgtgcagcgacagtgcccagggctctgatgtgtctctcacagcttgaaaagcctgagacagctgtcttgtgagggacygagatgcaggatttcttcacgcctcccctttgtgacttcaagagcctctggcatctctttctgcaaaggcacctgaatgtgtctgcgtccctgttagcat

SEQ ID NO: 1523 - DNA, 201 bp, Homo sapiens
gggcagtggccctgaccgagacctgggccggctcccactccatgaggtatttctacaccgccatgtcccggcccggccgcggggagccccgcttcatcacmgtgggctacgtggacgacacccagttcgtgaggttcgacagcgacgccacgagtccgaggatggcgccccgggcgccatggatagagcaggaggggccgg

SEQ ID NO: 1524 - DNA, 201 bp, Homo sapiens
agtccaccgtccccatcgtgggcattgttgctggcctggctgtcctagcagttgtggtcatcggagctgtggtcgctgctgtgatgtgtaggaggaagagytcaggtggaaaaggagggagctactctcaggctgcgtgcagcgacagtgcccagggctctgatgtgtctctcacagcttgaaaagcctgagacagctgtc

SEQ ID NO: 1525 - DNA, 201 bp, Homo sapiens
ggggggcagtggccctgaccgagacctgggccggctcccactccatgaggtatttctacaccgccatgtcccggcccggccgcggggagccccgcttcatyaccgtgggctacgtggacgacacccagttcgtgaggttcgacagcgacgccacgagtccgaggatggcgccccgggcgccatggatagagcaggaggggc

SEQ ID NO: 1526 - DNA, 201 bp, Homo sapiens
ccggactcagaatctcctcagacgccgagatgcgggtcacggcgccccgaaccgtcctcctgctgctctggggggcagtggccctgaccgagacctgggcbggctcccactccatgaggtatttctacaccgccatgtcccggcccggccgcggggagccccgcttcatcaccgtgggctacgtggacgacacccagttcg

SEQ ID NO: 1527 - DNA, 187 bp, Homo sapiens
cgcacccacccggactcagaatctcctcagacgccgagatgcgggtcacggcgccccgaaccgtcctcctgctgctctggggggcastggccctgaccgagacctgggccggctcccactccatgaggtatttctacaccgccatgtcccggcccggccgcggggagccccgcttcatcaccgtggg

SEQ ID NO: 1528 - DNA, 201 bp, Homo sapiens
ggagatcacactgacctggcagcgggatggcgaggaccaaactcaggacactgagcttgtggagaccagaccagcaggagatagaaccttccagaagtggrcagctgtggtggtgccttctggagaagagcagagatacacatgccatgtacagcatgaggggctgccgaagcccctcaccctgagatgggagccgtcttc

SEQ ID NO: 1529 - DNA, 201 bp, Homo sapiens
cctgggcttctaccctgcggagatcacactgacctggcagcgggatggcgaggaccaaactcaggacactgagcttgtggagaccagaccagcaggagatrgaaccttccagaagtgggcagctgtggtggtgccttctggagaagagcagagatacacatgccatgtacagcatgaggggctgccgaagcccctcaccct

SEQ ID NO: 1530 - DNA, 186 bp, Homo sapiens
cgcacccacccggactcagaatctcctcagacgccgagatgcgggtcacggcgccccgaaccgtcctcctgctgctctggggggcmgtggccctgaccgagacctgggccggctcccactccatgaggtatttctacaccgccatgtcccggcccggccgcggggagccccgcttcatcaccgtgg

SEQ ID NO: 1531 - DNA, 183 bp, Homo sapiens
cgcacccacccggactcagaatctcctcagacgccgagatgcgggtcacggcgccccgaaccgtcctcctgctgctctggggrgcagtggccctgaccgagacctgggccggctcccactccatgaggtatttctacaccgccatgtcccggcccggccgcggggagccccgcttcatcaccg

SEQ ID NO: 1532 - DNA, 182 bp, Homo sapiens
cgcacccacccggactcagaatctcctcagacgccgagatgcgggtcacggcgccccgaaccgtcctcctgctgctctgggsggcagtggccctgaccgagacctgggccggctcccactccatgaggtatttctacaccgccatgtcccggcccggccgcggggagccccgcttcatcacc

SEQ ID NO: 1533 - DNA, 201 bp, Homo sapiens
gagtggctccgcagatacctggagaacgggaaggagacgctgcagcgcgcggaccccccaaagacacacgtgacccaccaccccatctctgaccatgaggycaccctgaggtgctgggccctgggcttctaccctgcggagatcacactgacctggcagcgggatggcgaggaccaaactcaggacactgagcttgtggag

SEQ ID NO: 1534 - DNA, 201 bp, Homo sapiens
ctgaccatgaggccaccctgaggtgctgggccctgggcttctaccctgcggagatcacactgacctggcagcgggatggcgaggaccaaactcaggacacygagcttgtggagaccagaccagcaggagatagaaccttccagaagtgggcagctgtggtggtgccttctggagaagagcagagatacacatgccatgtac

SEQ ID NO: 1535 - DNA, 201 bp, Homo sapiens
acagcatgaggggctgccgaagcccctcaccctgagatgggagccgtcttcccagtccaccgtccccatcgtgggcattgttgctggcctggctgtcctakcagttgtggtcatcggagctgtggtcgctgctgtgatgtgtaggaggaagagctcaggtggaaaaggagggagctactctcaggctgcgtgcagcgacag

SEQ ID NO: 1536 - DNA, 201 bp, Homo sapiens
ccctgggcttctaccctgcggagatcacactgacctggcagcgggatggcgaggaccaaactcaggacactgagcttgtggagaccagaccagcaggagayagaaccttccagaagtgggcagctgtggtggtgccttctggagaagagcagagatacacatgccatgtacagcatgaggggctgccgaagcccctcaccc

SEQ ID NO: 1537 - DNA, 201 bp, Homo sapiens
tacagcatgaggggctgccgaagcccctcaccctgagatgggagccgtcttcccagtccaccgtccccatcgtgggcattgttgctggcctggctgtcctwgcagttgtggtcatcggagctgtggtcgctgctgtgatgtgtaggaggaagagctcaggtggaaaaggagggagctactctcaggctgcgtgcagcgaca

SEQ ID NO: 1538 - DNA, 201 bp, Homo sapiens
ccagaagtgggcagctgtggtggtgccttctggagaagagcagagatacacatgccatgtacagcatgaggggctgccgaagcccctcaccctgagatggragccgtcttcccagtccaccgtccccatcgtgggcattgttgctggcctggctgtcctagcagttgtggtcatcggagctgtggtcgctgctgtgatgtg

SEQ ID NO: 1539 - DNA, 153 bp, Homo sapiens
cgcacccacccggactcagaatctcctcagacgccgagatgcgggtcacggcrccccgaaccgtcctcctgctgctctggggggcagtggccctgaccgagacctgggccggctcccactccatgaggtatttctacaccgccatgtcccggc

SEQ ID NO: 1540 - DNA, 201 bp, Homo sapiens
gacggcaaggattacatcgccctgaacgaggacctgagctcctggaccgcggcggacaccgcggctcagatcacccagcgcaagtgggaggcggcccgtgwggcggagcagcagagagcctacctggagggcacgtgcgtggagtggctccgcagatacctggagaacgggaaggagacgctgcagcgcgcggacccccca

SEQ ID NO: 1541 - DNA, 152 bp, Homo sapiens
cgcacccacccggactcagaatctcctcagacgccgagatgcgggtcacggmgccccgaaccgtcctcctgctgctctggggggcagtggccctgaccgagacctgggccggctcccactccatgaggtatttctacaccgccatgtcccgg

SEQ ID NO: 1542 - DNA, 132 bp, Homo sapiens
tccctactgaaaataagaatctgaatataaatttgttttctcaaatatttgctatgagaggttgatggattaattaaataagtcaattcctggaatttgaragagcaaataaagacctgagaaccttccaga

SEQ ID NO: 1543 - DNA, 136 bp, Homo sapiens
tacttccctactgaaaataagaatctgaatataaatttgttttctcaaatatttgctatgagaggttgatggattaattaaataagtcaattcctggaatktgagagagcaaataaagacctgagaaccttccaga

SEQ ID NO: 1544 - DNA, 201 bp, Homo sapiens
tggcagcgggatggcgaggaccaaactcaggacactgagcttgtggagaccagaccagcaggagatagaaccttccagaagtgggcagctgtggtggtgcyttctggagaagagcagagatacacatgccatgtacagcatgaggggctgccgaagcccctcaccctgagatgggagccgtcttcccagtccaccgtcccc

SEQ ID NO: 1545 - DNA, 201 bp, Homo sapiens
gaccagcaggagatagaaccttccagaagtgggcagctgtggtggtgccttctggagaagagcagagatacacatgccatgtacagcatgaggggctgccraagcccctcaccctgagatgggagccgtcttcccagtccaccgtccccatcgtgggcattgttgctggcctggctgtcctagcagttgtggtcatcggag

SEQ ID NO: 1546 - DNA, 201 bp, Homo sapiens
ccaccgtccccatcgtgggcattgttgctggcctggctgtcctagcagttgtggtcatcggagctgtggtcgctgctgtgatgtgtaggaggaagagctcwggtggaaaaggagggagctactctcaggctgcgtgcagcgacagtgcccagggctctgatgtgtctctcacagcttgaaaagcctgagacagctgtcttg

SEQ ID NO: 1547 - DNA, 201 bp, Homo sapiens
atgggagccgtcttcccagtccaccgtccccatcgtgggcattgttgctggcctggctgtcctagcagttgtggtcatcggagctgtggtcgctgctgtgrtgtgtaggaggaagagctcaggtggaaaaggagggagctactctcaggctgcgtgcagcgacagtgcccagggctctgatgtgtctctcacagcttgaaa

SEQ ID NO: 1548 - DNA, 201 bp, Homo sapiens
cggcccgtgtggcggagcagcagagagcctacctggagggcacgtgcgtggagtggctccgcagatacctggagaacgggaaggagacgctgcagcgcgckgaccccccaaagacacacgtgacccaccaccccatctctgaccatgaggccaccctgaggtgctgggccctgggcttctaccctgcggagatcacactga

SEQ ID NO: 1549 - DNA, 201 bp, Homo sapiens
gtgggaggcggcccgtgtggcggagcagcagagagcctacctggagggcacgtgcgtggagtggctccgcagatacctggagaacgggaaggagacgctgsagcgcgcggaccccccaaagacacacgtgacccaccaccccatctctgaccatgaggccaccctgaggtgctgggccctgggcttctaccctgcggagat

SEQ ID NO: 1550 - DNA, 201 bp, Homo sapiens
gggggcagtggccctgaccgagacctgggccggctcccactccatgaggtatttctacaccgccatgtcccggcccggccgcggggagccccgcttcatcdccgtgggctacgtggacgacacccagttcgtgaggttcgacagcgacgccacgagtccgaggatggcgccccgggcgccatggatagagcaggaggggcc

SEQ ID NO: 1551 - DNA, 201 bp, Homo sapiens
cgcaagtgggaggcggcccgtgtggcggagcagcagagagcctacctggagggcacgtgcgtggagtggctccgcagatacctggagaacgggaaggagamgctgcagcgcgcggaccccccaaagacacacgtgacccaccaccccatctctgaccatgaggccaccctgaggtgctgggccctgggcttctaccctgcg

SEQ ID NO: 1552 - DNA, 201 bp, Homo sapiens
gcgggtcacggcgccccgaaccgtcctcctgctgctctggggggcagtggccctgaccgagacctgggccggctcccactccatgaggtatttctacacckccatgtcccggcccggccgcggggagccccgcttcatcaccgtgggctacgtggacgacacccagttcgtgaggttcgacagcgacgccacgagtccgag

SEQ ID NO: 1553 - DNA, 201 bp, Homo sapiens
agcgcaagtgggaggcggcccgtgtggcggagcagcagagagcctacctggagggcacgtgcgtggagtggctccgcagatacctggagaacgggaaggasacgctgcagcgcgcggaccccccaaagacacacgtgacccaccaccccatctctgaccatgaggccaccctgaggtgctgggccctgggcttctaccctg

SEQ ID NO: 1554 - DNA, 201 bp, Homo sapiens
ctggagaagagcagagatacacatgccatgtacagcatgaggggctgccgaagcccctcaccctgagatgggagccgtcttcccagtccaccgtccccatygtgggcattgttgctggcctggctgtcctagcagttgtggtcatcggagctgtggtcgctgctgtgatgtgtaggaggaagagctcaggtggaaaaggag

SEQ ID NO: 1555 - DNA, 201 bp, Homo sapiens
tgaggtgctgggccctgggcttctaccctgcggagatcacactgacctggcagcgggatggcgaggaccaaactcaggacactgagcttgtggagaccagrccagcaggagatagaaccttccagaagtgggcagctgtggtggtgccttctggagaagagcagagatacacatgccatgtacagcatgaggggctgccga

SEQ ID NO: 1556 - DNA, 201 bp, Homo sapiens
acgctgcagcgcgcggaccccccaaagacacacgtgacccaccaccccatctctgaccatgaggccaccctgaggtgctgggccctgggcttctaccctgsggagatcacactgacctggcagcgggatggcgaggaccaaactcaggacactgagcttgtggagaccagaccagcaggagatagaaccttccagaagtgg

SEQ ID NO: 1557 - DNA, 201 bp, Homo sapiens
tggcggagcagcagagagcctacctggagggcacgtgcgtggagtggctccgcagatacctggagaacgggaaggagacgctgcagcgcgcggaccccccdaagacacacgtgacccaccaccccatctctgaccatgaggccaccctgaggtgctgggccctgggcttctaccctgcggagatcacactgacctggcagc

SEQ ID NO: 1558 - DNA, 179 bp, Homo sapiens
cgcacccacccggactcagaatctcctcagacgccgagatgcgggtcacggcgccccgaaccgtcctcctgctgctctsgggggcagtggccctgaccgagacctgggccggctcccactccatgaggtatttctacaccgccatgtcccggcccggccgcggggagccccgcttcatc

SEQ ID NO: 1559 - DNA, 149 bp, Homo sapiens
cgcacccacccggactcagaatctcctcagacgccgagatgcgggtcayggcgccccgaaccgtcctcctgctgctctggggggcagtggccctgaccgagacctgggccggctcccactccatgaggtatttctacaccgccatgtcc

SEQ ID NO: 1560 - DNA, 201 bp, Homo sapiens
agtgggcagctgtggtggtgccttctggagaagagcagagatacacatgccatgtacagcatgaggggctgccgaagcccctcaccctgagatgggagccrtcttcccagtccaccgtccccatcgtgggcattgttgctggcctggctgtcctagcagttgtggtcatcggagctgtggtcgctgctgtgatgtgtagga

SEQ ID NO: 1561 - DNA, 201 bp, Homo sapiens
ctgtggtggtgccttctggagaagagcagagatacacatgccatgtacagcatgaggggctgccgaagcccctcaccctgagatgggagccgtcttcccartccaccgtccccatcgtgggcattgttgctggcctggctgtcctagcagttgtggtcatcggagctgtggtcgctgctgtgatgtgtaggaggaagagct

SEQ ID NO: 1562 - DNA, 201 bp, Homo sapiens
ttcctccccagtcatctttcttgttccagagaggtggggctggatgtctccatctctgtctcaactttacgtgcactgagctgcaacttcttacttccctrctgaaaataagaatctgaatataaatttgttttctcaaatatttgctatgagaggttgatggattaattaaataagtcaattcctggaatttgagagagc

SEQ ID NO: 1563 - DNA, 201 bp, Homo sapiens
tgtgacccctgttcccatgctgacctgtgtttcctccccagtcatctttcttgttccagagaggtggggctggatgtctccatctctgtctcaactttacrtgcactgagctgcaacttcttacttccctactgaaaataagaatctgaatataaatttgttttctcaaatatttgctatgagaggttgatggattaatta

SEQ ID NO: 1564 - DNA, 201 bp, Homo sapiens
ctgtgacccctgttcccatgctgacctgtgtttcctccccagtcatctttcttgttccagagaggtggggctggatgtctccatctctgtctcaactttaygtgcactgagctgcaacttcttacttccctactgaaaataagaatctgaatataaatttgttttctcaaatatttgctatgagaggttgatggattaatt

SEQ ID NO: 1565 - DNA, 201 bp, Homo sapiens
ggagatagaaccttccagaagtgggcagctgtggtggtgccttctggagaagagcagagatacacatgccatgtacagcatgaggggctgccgaagcccckcaccctgagatgggagccgtcttcccagtccaccgtccccatcgtgggcattgttgctggcctggctgtcctagcagttgtggtcatcggagctgtggtc

SEQ ID NO: 1566 - DNA, 201 bp, Homo sapiens
atgtgaggaggtggagagacagcccacccttgtgtccactgtgacccctgttcccatgctgacctgtgtttcctccccagtcatctttcttgttccagagrggtggggctggatgtctccatctctgtctcaactttacgtgcactgagctgcaacttcttacttccctactgaaaataagaatctgaatataaatttgtt

SEQ ID NO: 1567 - DNA, 201 bp, Homo sapiens
ctgttagcataatgtgaggaggtggagagacagcccacccttgtgtccactgtgacccctgttcccatgctgacctgtgtttcctccccagtcatctttcytgttccagagaggtggggctggatgtctccatctctgtctcaactttacgtgcactgagctgcaacttcttacttccctactgaaaataagaatctgaat

SEQ ID NO: 1568 - DNA, 143 bp, Homo sapiens
cgcacccacccggactcagaatctcctcagacgccgagatgckggtcacggcgccccgaaccgtcctcctgctgctctggggggcagtggccctgaccgagacctgggccggctcccactccatgaggtatttctacaccgcc

SEQ ID NO: 1569 - DNA, 201 bp, Homo sapiens
aaaggcacctgaatgtgtctgcgtccctgttagcataatgtgaggaggtggagagacagcccacccttgtgtccactgtgacccctgttcccatgctgacytgtgtttcctccccagtcatctttcttgttccagagaggtggggctggatgtctccatctctgtctcaactttacgtgcactgagctgcaacttcttact

SEQ ID NO: 1570 - DNA, 201 bp, Homo sapiens
caaaggcacctgaatgtgtctgcgtccctgttagcataatgtgaggaggtggagagacagcccacccttgtgtccactgtgacccctgttcccatgctgayctgtgtttcctccccagtcatctttcttgttccagagaggtggggctggatgtctccatctctgtctcaactttacgtgcactgagctgcaacttcttac

SEQ ID NO: 1571 - DNA, 201 bp, Homo sapiens
accgcggcggacaccgcggctcagatcacccagcgcaagtgggaggcggcccgtgtggcggagcagcagagagcctacctggagggcacgtgcgtggagtsgctccgcagatacctggagaacgggaaggagacgctgcagcgcgcggaccccccaaagacacacgtgacccaccaccccatctctgaccatgaggccacc

SEQ ID NO: 1572 - DNA, 201 bp, Homo sapiens
ggtgccttctggagaagagcagagatacacatgccatgtacagcatgaggggctgccgaagcccctcaccctgagatgggagccgtcttcccagtccaccrtccccatcgtgggcattgttgctggcctggctgtcctagcagttgtggtcatcggagctgtggtcgctgctgtgatgtgtaggaggaagagctcaggtgg

SEQ ID NO: 1573 - DNA, 201 bp, Homo sapiens
cgaagcccctcaccctgagatgggagccgtcttcccagtccaccgtccccatcgtgggcattgttgctggcctggctgtcctagcagttgtggtcatcggmgctgtggtcgctgctgtgatgtgtaggaggaagagctcaggtggaaaaggagggagctactctcaggctgcgtgcagcgacagtgcccagggctctgatg

SEQ ID NO: 1574 - DNA, 201 bp, Homo sapiens
agagcctctggcatctctttctgcaaaggcacctgaatgtgtctgcgtccctgttagcataatgtgaggaggtggagagacagcccacccttgtgtccacygtgacccctgttcccatgctgacctgtgtttcctccccagtcatctttcttgttccagagaggtggggctggatgtctccatctctgtctcaactttacg

SEQ ID NO: 1575 - DNA, 201 bp, Homo sapiens
ccgaagcccctcaccctgagatgggagccgtcttcccagtccaccgtccccatcgtgggcattgttgctggcctggctgtcctagcagttgtggtcatcgkagctgtggtcgctgctgtgatgtgtaggaggaagagctcaggtggaaaaggagggagctactctcaggctgcgtgcagcgacagtgcccagggctctgat

SEQ ID NO: 1576 - DNA, 201 bp, Homo sapiens
tcaccctgagatgggagccgtcttcccagtccaccgtccccatcgtgggcattgttgctggcctggctgtcctagcagttgtggtcatcggagctgtggtygctgctgtgatgtgtaggaggaagagctcaggtggaaaaggagggagctactctcaggctgcgtgcagcgacagtgcccagggctctgatgtgtctctca

SEQ ID NO: 1577 - DNA, 201 bp, Homo sapiens
ctgagctcctggaccgcggcggacaccgcggctcagatcacccagcgcaagtgggaggcggcccgtgtggcggagcagcagagagcctacctggagggcahgtgcgtggagtggctccgcagatacctggagaacgggaaggagacgctgcagcgcgcggaccccccaaagacacacgtgacccaccaccccatctctgac

SEQ ID NO: 1578 - DNA, 201 bp, Homo sapiens
tgccgaagcccctcaccctgagatgggagccgtcttcccagtccaccgtccccatcgtgggcattgttgctggcctggctgtcctagcagttgtggtcatsggagctgtggtcgctgctgtgatgtgtaggaggaagagctcaggtggaaaaggagggagctactctcaggctgcgtgcagcgacagtgcccagggctctg

SEQ ID NO: 1579 - DNA, 201 bp, Homo sapiens
cctgagctcctggaccgcggcggacaccgcggctcagatcacccagcgcaagtgggaggcggcccgtgtggcggagcagcagagagcctacctggagggcvcgtgcgtggagtggctccgcagatacctggagaacgggaaggagacgctgcagcgcgcggaccccccaaagacacacgtgacccaccaccccatctctga

SEQ ID NO: 1580 - DNA, 201 bp, Homo sapiens
cgccctgaacgaggacctgagctcctggaccgcggcggacaccgcggctcagatcacccagcgcaagtgggaggcggcccgtgtggcggagcagcagagarcctacctggagggcacgtgcgtggagtggctccgcagatacctggagaacgggaaggagacgctgcagcgcgcggaccccccaaagacacacgtgaccca

SEQ ID NO: 1581 - DNA, 201 bp, Homo sapiens
acgggaaggagacgctgcagcgcgcggaccccccaaagacacacgtgacccaccaccccatctctgaccatgaggccaccctgaggtgctgggccctgggyttctaccctgcggagatcacactgacctggcagcgggatggcgaggaccaaactcaggacactgagcttgtggagaccagaccagcaggagatagaacct

SEQ ID NO: 1582 - DNA, 201 bp, Homo sapiens
tacatcgccctgaacgaggacctgagctcctggaccgcggcggacaccgcggctcagatcacccagcgcaagtgggaggcggcccgtgtggcggagcagckgagagcctacctggagggcacgtgcgtggagtggctccgcagatacctggagaacgggaaggagacgctgcagcgcgcggaccccccaaagacacacgtg

SEQ ID NO: 1583 - DNA, 201 bp, Homo sapiens
ttacatcgccctgaacgaggacctgagctcctggaccgcggcggacaccgcggctcagatcacccagcgcaagtgggaggcggcccgtgtggcggagcagyagagagcctacctggagggcacgtgcgtggagtggctccgcagatacctggagaacgggaaggagacgctgcagcgcgcggaccccccaaagacacacgt

SEQ ID NO: 1584 - DNA, 201 bp, Homo sapiens
caccgcggctcagatcacccagcgcaagtgggaggcggcccgtgtggcggagcagcagagagcctacctggagggcacgtgcgtggagtggctccgcagayacctggagaacgggaaggagacgctgcagcgcgcggaccccccaaagacacacgtgacccaccaccccatctctgaccatgaggccaccctgaggtgctg

SEQ ID NO: 1585 - DNA, 201 bp, Homo sapiens
acaccgcggctcagatcacccagcgcaagtgggaggcggcccgtgtggcggagcagcagagagcctacctggagggcacgtgcgtggagtggctccgcagrtacctggagaacgggaaggagacgctgcagcgcgcggaccccccaaagacacacgtgacccaccaccccatctctgaccatgaggccaccctgaggtgct

SEQ ID NO: 1586 - DNA, 201 bp, Homo sapiens
gaccgcggcggacaccgcggctcagatcacccagcgcaagtgggaggcggcccgtgtggcggagcagcagagagcctacctggagggcacgtgcgtggagkggctccgcagatacctggagaacgggaaggagacgctgcagcgcgcggaccccccaaagacacacgtgacccaccaccccatctctgaccatgaggccac

SEQ ID NO: 1587 - DNA, 201 bp, Homo sapiens
cgagatgcgggtcacggcgccccgaaccgtcctcctgctgctctggggggcagtggccctgaccgagacctgggccggctcccactccatgaggtatttcbacaccgccatgtcccggcccggccgcggggagccccgcttcatcaccgtgggctacgtggacgacacccagttcgtgaggttcgacagcgacgccacgag

SEQ ID NO: 1588 - DNA, 201 bp, Homo sapiens
aggagatagaaccttccagaagtgggcagctgtggtggtgccttctggagaagagcagagatacacatgccatgtacagcatgaggggctgccgaagcccytcaccctgagatgggagccgtcttcccagtccaccgtccccatcgtgggcattgttgctggcctggctgtcctagcagttgtggtcatcggagctgtggt

SEQ ID NO: 1589 - DNA, 201 bp, Homo sapiens
accagcaggagatagaaccttccagaagtgggcagctgtggtggtgccttctggagaagagcagagatacacatgccatgtacagcatgaggggctgccgragcccctcaccctgagatgggagccgtcttcccagtccaccgtccccatcgtgggcattgttgctggcctggctgtcctagcagttgtggtcatcggagc

SEQ ID NO: 1590 - DNA, 201 bp, Homo sapiens
ggaccgcggcggacaccgcggctcagatcacccagcgcaagtgggaggcggcccgtgtggcggagcagcagagagcctacctggagggcacgtgcgtggabtggctccgcagatacctggagaacgggaaggagacgctgcagcgcgcggaccccccaaagacacacgtgacccaccaccccatctctgaccatgaggcca

SEQ ID NO: 1591 - DNA, 201 bp, Homo sapiens
gtgacttcaagagcctctggcatctctttctgcaaaggcacctgaatgtgtctgcgtccctgttagcataatgtgaggaggtggagagacagcccaccctygtgtccactgtgacccctgttcccatgctgacctgtgtttcctccccagtcatctttcttgttccagagaggtggggctggatgtctccatctctgtctc

SEQ ID NO: 1592 - DNA, 201 bp, Homo sapiens
tgtgacttcaagagcctctggcatctctttctgcaaaggcacctgaatgtgtctgcgtccctgttagcataatgtgaggaggtggagagacagcccacccytgtgtccactgtgacccctgttcccatgctgacctgtgtttcctccccagtcatctttcttgttccagagaggtggggctggatgtctccatctctgtct

SEQ ID NO: 1593 - DNA, 201 bp, Homo sapiens
ctttgtgacttcaagagcctctggcatctctttctgcaaaggcacctgaatgtgtctgcgtccctgttagcataatgtgaggaggtggagagacagcccamccttgtgtccactgtgacccctgttcccatgctgacctgtgtttcctccccagtcatctttcttgttccagagaggtggggctggatgtctccatctctg

SEQ ID NO: 1594 - DNA, 201 bp, Homo sapiens
agaccagcaggagatagaaccttccagaagtgggcagctgtggtggtgccttctggagaagagcagagatacacatgccatgtacagcatgaggggctgcmgaagcccctcaccctgagatgggagccgtcttcccagtccaccgtccccatcgtgggcattgttgctggcctggctgtcctagcagttgtggtcatcgga

SEQ ID NO: 1595 - DNA, 201 bp, Homo sapiens
ttgtggagaccagaccagcaggagatagaaccttccagaagtgggcagctgtggtggtgccttctggagaagagcagagatacacatgccatgtacagcaygaggggctgccgaagcccctcaccctgagatggggtaaggagggggatgaggggtcatatctcttctcagggaaagcaggagcccttcagcagggtcagg

SEQ ID NO: 1596 - DNA, 201 bp, Homo sapiens; identical to SEQ ID NO: 1495

SEQ ID NO: 1597 - DNA, 201 bp, Homo sapiens; identical to SEQ ID NO: 1496

SEQ ID NO: 1598 - DNA, 201 bp, Homo sapiens; identical to SEQ ID NO: 1497

SEQ ID NO: 1599 - DNA, 201 bp, Homo sapiens; identical to SEQ ID NO: 1498

SEQ ID NO: 1600 - DNA, 201 bp, Homo sapiens; identical to SEQ ID NO: 1499

SEQ ID NO: 1601 - DNA, 201 bp, Homo sapiens
cctcattactgggaagcagcatccacacaggggctaacgcagcctgggaccctgtgtgccagcacttactcttttgtgcagcacatgtgacaatgaaggayggatgtatcaccttggtggttgtggtgttggggtcctgattccagcattcatgagtcaggggaaggtccctgctaaggacagaccttaggagggcagttg

SEQ ID NO: 1602 - DNA, 201 bp, Homo sapiens; identical to SEQ ID NO: 1500

SEQ ID NO: 1603 - DNA, 201 bp, Homo sapiens; identical to SEQ ID NO: 1501

SEQ ID NO: 1604 - DNA, 201 bp, Homo sapiens
tagggaaggggtgaggggtggggtctgggttttcttgtcccactgggggtttcaagccccaggtagaagtgttccctgcctcattactgggaagcagcatscacacaggggctaacgcagcctgggaccctgtgtgccagcacttactcttttgtgcagcacatgtgacaatgaaggacggatgtatcaccttggtggttg

SEQ ID NO: 1605 - DNA, 201 bp, Homo sapiens; identical to SEQ ID NO: 1502

SEQ ID NO: 1606 - DNA, 201 bp, Homo sapiens; identical to SEQ ID NO: 1503

SEQ ID NO: 1607 - DNA, 201 bp, Homo sapiens
tcctttcccagagccgtcttcccagtccaccgtccccatcgtgggcattgttgctggcctggctgtcctagcagttgtggtcatcggagctgtggtcgctrctgtgatgtgtaggaggaagagctcaggtagggaaggggtgaggggtggggtctgggttttcttgtcccactgggggtttcaagccccaggtagaagtgt

SEQ ID NO: 1608 - DNA, 201 bp, Homo sapiens
gggcccctcatcttcccctcctttcccagagccgtcttcccagtccaccgtccccatcgtgggcattgttgctggcctggctgtcctagcagttgtggtcrtcggagctgtggtcgctgctgtgatgtgtaggaggaagagctcaggtagggaaggggtgaggggtggggtctgggttttcttgtcccactgggggtttca

SEQ ID NO: 1609 - DNA, 201 bp, Homo sapiens
agggcccctcatcttcccctcctttcccagagccgtcttcccagtccaccgtccccatcgtgggcattgttgctggcctggctgtcctagcagttgtggtyatcggagctgtggtcgctgctgtgatgtgtaggaggaagagctcaggtagggaaggggtgaggggtggggtctgggttttcttgtcccactgggggtttc

SEQ ID NO: 1610 - DNA, 201 bp, Homo sapiens
gcagggtcagggcccctcatcttcccctcctttcccagagccgtcttcccagtccaccgtccccatcgtgggcattgttgctggcctggctgtcctagcarttgtggtcatcggagctgtggtcgctgctgtgatgtgtaggaggaagagctcaggtagggaaggggtgaggggtggggtctgggttttcttgtcccactg

SEQ ID NO: 1611 - DNA, 201 bp, Homo sapiens
agcagggtcagggcccctcatcttcccctcctttcccagagccgtcttcccagtccaccgtccccatcgtgggcattgttgctggcctggctgtcctagcmgttgtggtcatcggagctgtggtcgctgctgtgatgtgtaggaggaagagctcaggtagggaaggggtgaggggtggggtctgggttttcttgtcccact

SEQ ID NO: 1612 - DNA, 201 bp, Homo sapiens; identical to SEQ ID NO: 1509

SEQ ID NO: 1613 - DNA, 201 bp, Homo sapiens
cagcagggtcagggcccctcatcttcccctcctttcccagagccgtcttcccagtccaccgtccccatcgtgggcattgttgctggcctggctgtcctagyagttgtggtcatcggagctgtggtcgctgctgtgatgtgtaggaggaagagctcaggtagggaaggggtgaggggtggggtctgggttttcttgtcccac

SEQ ID NO: 1614 - DNA, 201 bp, Homo sapiens; identical to SEQ ID NO: 1511

SEQ ID NO: 1615 - DNA, 201 bp, Homo sapiens
ctgagcttgtggagaccagaccagcaggagatagaaccttccagaagtgggcagctgtggtggtgccttctggagaagagcagagatacacatgccatgtrcagcatgaggggctgccgaagcccctcaccctgagatggggtaaggagggggatgaggggtcatatctcttctcagggaaagcaggagcccttcagcagg

SEQ ID NO: 1616 - DNA, 201 bp, Homo sapiens; identical to SEQ ID NO: 1513

SEQ ID NO: 1617 - DNA, 201 bp, Homo sapiens; identical to SEQ ID NO: 1514

SEQ ID NO: 1618 - DNA, 201 bp, Homo sapiens; identical to SEQ ID NO: 1515

SEQ ID NO: 1619 - DNA, 201 bp, Homo sapiens; identical to SEQ ID NO: 1516

SEQ ID NO: 1620 - DNA, 201 bp, Homo sapiens; identical to SEQ ID NO: 1517

SEQ ID NO: 1621 - DNA, 201 bp, Homo sapiens
ctcaggacactgagcttgtggagaccagaccagcaggagatagaaccttccagaagtgggcagctgtggtggtgccttctggagaagagcagagatacacrtgccatgtacagcatgaggggctgccgaagcccctcaccctgagatggggtaaggagggggatgaggggtcatatctcttctcagggaaagcaggagccc

SEQ ID NO: 1622 - DNA, 201 bp, Homo sapiens
gcgaggaccaaactcaggacactgagcttgtggagaccagaccagcaggagatagaaccttccagaagtgggcagctgtggtggtgccttctggagaagarcagagatacacatgccatgtacagcatgaggggctgccgaagcccctcaccctgagatggggtaaggagggggatgaggggtcatatctcttctcaggga

SEQ ID NO: 1623 - DNA, 201 bp, Homo sapiens
tccaggcagcgacagtgcccagggctctgatgtgtctctcacagcttgaaaagcctgagacagctgtcttgtgagggactgagatgcaggatttcttcackcctcccctttgtgacttcaagagcctctggcatctctttctgcaaaggcacctgaatgtgtctgcgtccctgttagcataatgtgaggaggtggagagac

SEQ ID NO: 1624 - DNA, 201 bp, Homo sapiens
ggatggcgaggaccaaactcaggacactgagcttgtggagaccagaccagcaggagatagaaccttccagaagtgggcagctgtggtggtgccttctggasaagagcagagatacacatgccatgtacagcatgaggggctgccgaagcccctcaccctgagatggggtaaggagggggatgaggggtcatatctcttctc

SEQ ID NO: 1625 - DNA, 201 bp, Homo sapiens
caggtcctgtttttgttctactccaggcagcgacagtgcccagggctctgatgtgtctctcacagcttgaaaagcctgagacagctgtcttgtgagggacygagatgcaggatttcttcacgcctcccctttgtgacttcaagagcctctggcatctctttctgcaaaggcacctgaatgtgtctgcgtccctgttagcat

SEQ ID NO: 1626 - DNA, 201 bp, Homo sapiens; identical to SEQ ID NO: 1523

SEQ ID NO: 1627 - DNA, 201 bp, Homo sapiens
agtccaccgtccccatcgtgggcattgttgctggcctggctgtcctagcagttgtggtcatcggagctgtggtcgctgctgtgatgtgtaggaggaagagytcaggtagggaaggggtgaggggtggggtctgggttttcttgtcccactgggggtttcaagccccaggtagaagtgttccctgcctcattactgggaagc

SEQ ID NO: 1628 - DNA, 201 bp, Homo sapiens; identical to SEQ ID NO: 1525

SEQ ID NO: 1629 - DNA, 201 bp, Homo sapiens
cccctcaccctgagatggggtaaggagggggatgaggggtcatatctcttctcagggaaagcaggagcccttcagcagggtcagggcccctcatcttcccytcctttcccagagccgtcttcccagtccaccgtccccatcgtgggcattgttgctggcctggctgtcctagcagttgtggtcatcggagctgtggtcgct

SEQ ID NO: 1630 - DNA, 201 bp, Homo sapiens; identical to SEQ ID NO: 1526

SEQ ID NO: 1631 - DNA, 187 bp, Homo sapiens; identical to SEQ ID NO: 1527

SEQ ID NO: 1632 - DNA, 201 bp, Homo sapiens
ggagatcacactgacctggcagcgggatggcgaggaccaaactcaggacactgagcttgtggagaccagaccagcaggagatagaaccttccagaagtggrcagctgtggtggtgccttctggagaagagcagagatacacatgccatgtacagcatgaggggctgccgaagcccctcaccctgagatggggtaaggaggg

SEQ ID NO: 1633 - DNA, 201 bp, Homo sapiens; identical to SEQ ID NO: 1529

SEQ ID NO: 1634 - DNA, 186 bp, Homo sapiens; identical to SEQ ID NO: 1530

SEQ ID NO: 1635 - DNA, 183 bp, Homo sapiens; identical to SEQ ID NO: 1531

SEQ ID NO: 1636 - DNA, 182 bp, Homo sapiens; identical to SEQ ID NO: 1532

SEQ ID NO: 1637 - DNA, 201 bp, Homo sapiens
gtgtaggaggaagagctcaggtagggaaggggtgaggggtggggtctgggttttcttgtcccactgggggtttcaagccccaggtagaagtgttccctgcmtcattactgggaagcagcatccacacaggggctaacgcagcctgggaccctgtgtgccagcacttactcttttgtgcagcacatgtgacaatgaaggacg

SEQ ID NO: 1638 - DNA, 201 bp, Homo sapiens; identical to SEQ ID NO: 1533

SEQ ID NO: 1639 - DNA, 201 bp, Homo sapiens; identical to SEQ ID NO: 1534

SEQ ID NO: 1640 - DNA, 201 bp, Homo sapiens
tcagcagggtcagggcccctcatcttcccctcctttcccagagccgtcttcccagtccaccgtccccatcgtgggcattgttgctggcctggctgtcctakcagttgtggtcatcggagctgtggtcgctgctgtgatgtgtaggaggaagagctcaggtagggaaggggtgaggggtggggtctgggttttcttgtccca

SEQ ID NO: 1641 - DNA, 201 bp, Homo sapiens; identical to SEQ ID NO: 1536

SEQ ID NO: 1642 - DNA, 201 bp, Homo sapiens
ttcagcagggtcagggcccctcatcttcccctcctttcccagagccgtcttcccagtccaccgtccccatcgtgggcattgttgctggcctggctgtcctwgcagttgtggtcatcggagctgtggtcgctgctgtgatgtgtaggaggaagagctcaggtagggaaggggtgaggggtggggtctgggttttcttgtccc

SEQ ID NO: 1643 - DNA, 201 bp, Homo sapiens
ccagaagtgggcagctgtggtggtgccttctggagaagagcagagatacacatgccatgtacagcatgaggggctgccgaagcccctcaccctgagatggrgtaaggagggggatgaggggtcatatctcttctcagggaaagcaggagcccttcagcagggtcagggcccctcatcttcccctcctttcccagagccgtc

SEQ ID NO: 1644 - DNA, 153 bp, Homo sapiens; identical to SEQ ID NO: 1539

SEQ ID NO: 1645 - DNA, 201 bp, Homo sapiens; identical to SEQ ID NO: 1540

SEQ ID NO: 1646 - DNA, 152 bp, Homo sapiens; identical to SEQ ID NO: 1541

SEQ ID NO: 1647 - DNA, 201 bp, Homo sapiens
gcctggctgtcctagcagttgtggtcatcggagctgtggtcgctgctgtgatgtgtaggaggaagagctcaggtagggaaggggtgaggggtggggtctgrgttttcttgtcccactgggggtttcaagccccaggtagaagtgttccctgcctcattactgggaagcagcatccacacaggggctaacgcagcctgggac

SEQ ID NO: 1648 - DNA, 201 bp, Homo sapiens
tctcatggccctgcttcctcccagtcccctcacagggcattttcttcccacaggtggaaaaggagggagctactctcaggctgcgtgtaagtgatgggggygggagtgtggaggagctcacccaccccataattcctcctgtcccacgtctcctgcgggctctgaccaggtcctgtttttgttctactccaggcagcgaca

SEQ ID NO: 1649 - DNA, 132 bp, Homo sapiens; identical to SEQ ID NO: 1542

SEQ ID NO: 1650 - DNA, 136 bp, Homo sapiens; identical to SEQ ID NO: 1543

SEQ ID NO: 1651 - DNA, 201 bp, Homo sapiens
tggcagcgggatggcgaggaccaaactcaggacactgagcttgtggagaccagaccagcaggagatagaaccttccagaagtgggcagctgtggtggtgcyttctggagaagagcagagatacacatgccatgtacagcatgaggggctgccgaagcccctcaccctgagatggggtaaggagggggatgaggggtcatat

SEQ ID NO: 1652 - DNA, 201 bp, Homo sapiens
gaccagcaggagatagaaccttccagaagtgggcagctgtggtggtgccttctggagaagagcagagatacacatgccatgtacagcatgaggggctgccraagcccctcaccctgagatggggtaaggagggggatgaggggtcatatctcttctcagggaaagcaggagcccttcagcagggtcagggcccctcatctt

SEQ ID NO: 1653 - DNA, 201 bp, Homo sapiens
ccaccgtccccatcgtgggcattgttgctggcctggctgtcctagcagttgtggtcatcggagctgtggtcgctgctgtgatgtgtaggaggaagagctcwggtagggaaggggtgaggggtggggtctgggttttcttgtcccactgggggtttcaagccccaggtagaagtgttccctgcctcattactgggaagcagc

SEQ ID NO: 1654 - DNA, 201 bp, Homo sapiens
ctggcctggctgtcctagcagttgtggtcatcggagctgtggtcgctgctgtgatgtgtaggaggaagagctcaggtagggaaggggtgaggggtggggtytgggttttcttgtcccactgggggtttcaagccccaggtagaagtgttccctgcctcattactgggaagcagcatccacacaggggctaacgcagcctgg

SEQ ID NO: 1655 - DNA, 201 bp, Homo sapiens
cccagagccgtcttcccagtccaccgtccccatcgtgggcattgttgctggcctggctgtcctagcagttgtggtcatcggagctgtggtcgctgctgtgrtgtgtaggaggaagagctcaggtagggaaggggtgaggggtggggtctgggttttcttgtcccactgggggtttcaagccccaggtagaagtgttccctg

SEQ ID NO: 1656 - DNA, 201 bp, Homo sapiens; identical to SEQ ID NO: 1548

SEQ ID NO: 1657 - DNA, 201 bp, Homo sapiens; identical to SEQ ID NO: 1549

SEQ ID NO: 1658 - DNA, 201 bp, Homo sapiens; identical to SEQ ID NO: 1550

SEQ ID NO: 1659 - DNA, 201 bp, Homo sapiens; identical to SEQ ID NO: 1551

SEQ ID NO: 1660 - DNA, 201 bp, Homo sapiens; identical to SEQ ID NO: 1552

SEQ ID NO: 1661 - DNA, 201 bp, Homo sapiens; identical to SEQ ID NO: 1553

SEQ ID NO: 1662 - DNA, 201 bp, Homo sapiens
catatctcttctcagggaaagcaggagcccttcagcagggtcagggcccctcatcttcccctcctttcccagagccgtcttcccagtccaccgtccccatygtgggcattgttgctggcctggctgtcctagcagttgtggtcatcggagctgtggtcgctgctgtgatgtgtaggaggaagagctcaggtagggaagggg

SEQ ID NO: 1663 - DNA, 201 bp, Homo sapiens; identical to SEQ ID NO: 1555

SEQ ID NO: 1664 - DNA, 201 bp, Homo sapiens; identical to SEQ ID NO: 1556

SEQ ID NO: 1665 - DNA, 201 bp, Homo sapiens; identical to SEQ ID NO: 1557

SEQ ID NO: 1666 - DNA, 201 bp, Homo sapiens
tctaagatctcatggccctgcttcctcccagtcccctcacagggcattttcttcccacaggtggaaaaggagggagctactctcaggctgcgtgtaagtgrtgggggtgggagtgtggaggagctcacccaccccataattcctcctgtcccacgtctcctgcgggctctgaccaggtcctgtttttgttctactccaggc

SEQ ID NO: 1667 - DNA, 179 bp, Homo sapiens; identical to SEQ ID NO: 1558

SEQ ID NO: 1668 - DNA, 149 bp, Homo sapiens; identical to SEQ ID NO: 1559

SEQ ID NO: 1669 - DNA, 201 bp, Homo sapiens
ggggtaaggagggggatgaggggtcatatctcttctcagggaaagcaggagcccttcagcagggtcagggcccctcatcttcccctcctttcccagagccrtcttcccagtccaccgtccccatcgtgggcattgttgctggcctggctgtcctagcagttgtggtcatcggagctgtggtcgctgctgtgatgtgtagga

SEQ ID NO: 1670 - DNA, 201 bp, Homo sapiens
agggggatgaggggtcatatctcttctcagggaaagcaggagcccttcagcagggtcagggcccctcatcttcccctcctttcccagagccgtcttcccartccaccgtccccatcgtgggcattgttgctggcctggctgtcctagcagttgtggtcatcggagctgtggtcgctgctgtgatgtgtaggaggaagagct

SEQ ID NO: 1671 - DNA, 201 bp, Homo sapiens; identical to SEQ ID NO: 1562

SEQ ID NO: 1672 - DNA, 201 bp, Homo sapiens; identical to SEQ ID NO: 1563

SEQ ID NO: 1673 - DNA, 201 bp, Homo sapiens; identical to SEQ ID NO: 1564

SEQ ID NO: 1674 - DNA, 201 bp, Homo sapiens
ggagatagaaccttccagaagtgggcagctgtggtggtgccttctggagaagagcagagatacacatgccatgtacagcatgaggggctgccgaagcccckcaccctgagatggggtaaggagggggatgaggggtcatatctcttctcagggaaagcaggagcccttcagcagggtcagggcccctcatcttcccctcct

SEQ ID NO: 1675 - DNA, 201 bp, Homo sapiens
gcattcatgagtcaggggaaggtccctgctaaggacagaccttaggagggcagttggtccaggacccacacttgctttcctcgtgtttcctgatcctgccytgggtctgtagtcatacttctggaaattccttttgggtccaagacgaggaggttcctctaagatctcatggccctgcttcctcccagtcccctcacaggg

SEQ ID NO: 1676 - DNA, 201 bp, Homo sapiens; identical to SEQ ID NO: 1566

SEQ ID NO: 1677 - DNA, 201 bp, Homo sapiens
agctcaggtagggaaggggtgaggggtggggtctgggttttcttgtcccactgggggtttcaagccccaggtagaagtgttccctgcctcattactgggawgcagcatccacacaggggctaacgcagcctgggaccctgtgtgccagcacttactcttttgtgcagcacatgtgacaatgaaggacggatgtatcacctt

SEQ ID NO: 1678 - DNA, 201 bp, Homo sapiens; identical to SEQ ID NO: 1567

SEQ ID NO: 1679 - DNA, 143 bp, Homo sapiens; identical to SEQ ID NO: 1568

SEQ ID NO: 1680 - DNA, 201 bp, Homo sapiens; identical to SEQ ID NO: 1569

SEQ ID NO: 1681 - DNA, 201 bp, Homo sapiens; identical to SEQ ID NO: 1570

SEQ ID NO: 1682 - DNA, 201 bp, Homo sapiens; identical to SEQ ID NO: 1571

SEQ ID NO: 1683 - DNA, 201 bp, Homo sapiens
tgaggggtcatatctcttctcagggaaagcaggagcccttcagcagggtcagggcccctcatcttcccctcctttcccagagccgtcttcccagtccaccrtccccatcgtgggcattgttgctggcctggctgtcctagcagttgtggtcatcggagctgtggtcgctgctgtgatgtgtaggaggaagagctcaggtag

SEQ ID NO: 1684 - DNA, 201 bp, Homo sapiens
cctcatcttcccctcctttcccagagccgtcttcccagtccaccgtccccatcgtgggcattgttgctggcctggctgtcctagcagttgtggtcatcggmgctgtggtcgctgctgtgatgtgtaggaggaagagctcaggtagggaaggggtgaggggtggggtctgggttttcttgtcccactgggggtttcaagccc

SEQ ID NO: 1685 - DNA, 201 bp, Homo sapiens; identical to SEQ ID NO: 1574

SEQ ID NO: 1686 - DNA, 201 bp, Homo sapiens
ccctcatcttcccctcctttcccagagccgtcttcccagtccaccgtccccatcgtgggcattgttgctggcctggctgtcctagcagttgtggtcatcgkagctgtggtcgctgctgtgatgtgtaggaggaagagctcaggtagggaaggggtgaggggtggggtctgggttttcttgtcccactgggggtttcaagcc

SEQ ID NO: 1687 - DNA, 201 bp, Homo sapiens
cccctcctttcccagagccgtcttcccagtccaccgtccccatcgtgggcattgttgctggcctggctgtcctagcagttgtggtcatcggagctgtggtygctgctgtgatgtgtaggaggaagagctcaggtagggaaggggtgaggggtggggtctgggttttcttgtcccactgggggtttcaagccccaggtagaa

SEQ ID NO: 1688 - DNA, 201 bp, Homo sapiens; identical to SEQ ID NO: 1577

SEQ ID NO: 1689 - DNA, 201 bp, Homo sapiens
gcccctcatcttcccctcctttcccagagccgtcttcccagtccaccgtccccatcgtgggcattgttgctggcctggctgtcctagcagttgtggtcatsggagctgtggtcgctgctgtgatgtgtaggaggaagagctcaggtagggaaggggtgaggggtggggtctgggttttcttgtcccactgggggtttcaag

SEQ ID NO: 1690 - DNA, 201 bp, Homo sapiens; identical to SEQ ID NO: 1579

SEQ ID NO: 1691 - DNA, 201 bp, Homo sapiens; identical to SEQ ID NO: 1580

SEQ ID NO: 1692 - DNA, 201 bp, Homo sapiens; identical to SEQ ID NO: 1581

SEQ ID NO: 1693 - DNA, 201 bp, Homo sapiens; identical to SEQ ID NO: 1582

SEQ ID NO: 1694 - DNA, 201 bp, Homo sapiens
cagcatccacacaggggctaacgcagcctgggaccctgtgtgccagcacttactcttttgtgcagcacatgtgacaatgaaggacggatgtatcaccttgrtggttgtggtgttggggtcctgattccagcattcatgagtcaggggaaggtccctgctaaggacagaccttaggagggcagttggtccaggacccacact

SEQ ID NO: 1695 - DNA, 201 bp, Homo sapiens; identical to SEQ ID NO: 1583

SEQ ID NO: 1696 - DNA, 201 bp, Homo sapiens
tgccgaagcccctcaccctgagatggggtaaggagggggatgaggggtcatatctcttctcagggaaagcaggagcccttcagcagggtcagggcccctcrtcttcccctcctttcccagagccgtcttcccagtccaccgtccccatcgtgggcattgttgctggcctggctgtcctagcagttgtggtcatcggagctg

SEQ ID NO: 1697 - DNA, 201 bp, Homo sapiens
ctggagaagagcagagatacacatgccatgtacagcatgaggggctgccgaagcccctcaccctgagatggggtaaggagggggatgaggggtcatatctsttctcagggaaagcaggagcccttcagcagggtcagggcccctcatcttcccctcctttcccagagccgtcttcccagtccaccgtccccatcgtgggca

SEQ ID NO: 1698 - DNA, 201 bp, Homo sapiens
ctgatcctgccttgggtctgtagtcatacttctggaaattccttttgggtccaagacgaggaggttcctctaagatctcatggccctgcttcctcccagtsccctcacagggcattttcttcccacaggtggaaaaggagggagctactctcaggctgcgtgtaagtgatgggggtgggagtgtggaggagctcacccacc

SEQ ID NO: 1699 - DNA, 201 bp, Homo sapiens; identical to SEQ ID NO: 1584

SEQ ID NO: 1700 - DNA, 201 bp, Homo sapiens; identical to SEQ ID NO: 1585

SEQ ID NO: 1701 - DNA, 201 bp, Homo sapiens; identical to SEQ ID NO: 1586

SEQ ID NO: 1702 - DNA, 201 bp, Homo sapiens; identical to SEQ ID NO: 1587

SEQ ID NO: 1703 - DNA, 201 bp, Homo sapiens
aggagatagaaccttccagaagtgggcagctgtggtggtgccttctggagaagagcagagatacacatgccatgtacagcatgaggggctgccgaagcccytcaccctgagatggggtaaggagggggatgaggggtcatatctcttctcagggaaagcaggagcccttcagcagggtcagggcccctcatcttcccctcc

SEQ ID NO: 1704 - DNA, 201 bp, Homo sapiens
accagcaggagatagaaccttccagaagtgggcagctgtggtggtgccttctggagaagagcagagatacacatgccatgtacagcatgaggggctgccgragcccctcaccctgagatggggtaaggagggggatgaggggtcatatctcttctcagggaaagcaggagcccttcagcagggtcagggcccctcatcttc

SEQ ID NO: 1705 - DNA, 201 bp, Homo sapiens; identical to SEQ ID NO: 1590

SEQ ID NO: 1706 - DNA, 201 bp, Homo sapiens; identical to SEQ ID NO: 1591

SEQ ID NO: 1707 - DNA, 201 bp, Homo sapiens; identical to SEQ ID NO: 1592

SEQ ID NO: 1708 - DNA, 201 bp, Homo sapiens; identical to SEQ ID NO: 1593

SEQ ID NO: 1709 - DNA, 201 bp, Homo sapiens
agaccagcaggagatagaaccttccagaagtgggcagctgtggtggtgccttctggagaagagcagagatacacatgccatgtacagcatgaggggctgcmgaagcccctcaccctgagatggggtaaggagggggatgaggggtcatatctcttctcagggaaagcaggagcccttcagcagggtcagggcccctcatct

SEQ ID NO: 1710 - DNA, 201 bp, Homo sapiens; identical to SEQ ID NO: 1494

SEQ ID NO: 1711 - DNA, 201 bp, Homo sapiens; identical to SEQ ID NO: 1495

SEQ ID NO: 1712 - DNA, 201 bp, Homo sapiens; identical to SEQ ID NO: 1496

SEQ ID NO: 1713 - DNA, 201 bp, Homo sapiens; identical to SEQ ID NO: 1497

SEQ ID NO: 1714 - DNA, 201 bp, Homo sapiens; identical to SEQ ID NO: 1498

SEQ ID NO: 1715 - DNA, 201 bp, Homo sapiens
cggggccagggtctcacatcatccagaggatgtacggctgcgacgtggggccggacgggcgcctcctccgcgggtatgaccaggacgcctacgacggcaargattacatcgccctgaacgaggacctgagctcctggaccgcggcggacaccgcggctcagatcacccagcgcaagtgggaggcggcccgtgtggcggagc

SEQ ID NO: 1716 - DNA, 201 bp, Homo sapiens
gggctgaccgcggggccggggccagggtctcacatcatccagaggatgtacggctgcgacgtggggccggacgggcgcctcctccgcgggtatgaccagghcgcctacgacggcaaggattacatcgccctgaacgaggacctgagctcctggaccgcggcggacaccgcggctcagatcacccagcgcaagtgggaggcg

SEQ ID NO: 1717 - DNA, 201 bp, Homo sapiens
ggggacggggctgaccgcggggccggggccagggtctcacatcatccagaggatgtacggctgcgacgtggggccggacgggcgcctcctccgcgggtatvaccaggacgcctacgacggcaaggattacatcgccctgaacgaggacctgagctcctggaccgcggcggacaccgcggctcagatcacccagcgcaagtg

SEQ ID NO: 1718 - DNA, 201 bp, Homo sapiens
gggggacggggctgaccgcggggccggggccagggtctcacatcatccagaggatgtacggctgcgacgtggggccggacgggcgcctcctccgcgggtaygaccaggacgcctacgacggcaaggattacatcgccctgaacgaggacctgagctcctggaccgcggcggacaccgcggctcagatcacccagcgcaagt

SEQ ID NO: 1719 - DNA, 201 bp, Homo sapiens
tcgggggacggggctgaccgcggggccggggccagggtctcacatcatccagaggatgtacggctgcgacgtggggccggacgggcgcctcctccgcgggyatgaccaggacgcctacgacggcaaggattacatcgccctgaacgaggacctgagctcctggaccgcggcggacaccgcggctcagatcacccagcgcaa

SEQ ID NO: 1720 - DNA, 201 bp, Homo sapiens; identical to SEQ ID NO: 1504

SEQ ID NO: 1721 - DNA, 201 bp, Homo sapiens; identical to SEQ ID NO: 1505

SEQ ID NO: 1722 - DNA, 201 bp, Homo sapiens; identical to SEQ ID NO: 1506

SEQ ID NO: 1723 - DNA, 201 bp, Homo sapiens; identical to SEQ ID NO: 1507

SEQ ID NO: 1724 - DNA, 201 bp, Homo sapiens; identical to SEQ ID NO: 1508

SEQ ID NO: 1725 - DNA, 201 bp, Homo sapiens; identical to SEQ ID NO: 1509

SEQ ID NO: 1726 - DNA, 201 bp, Homo sapiens; identical to SEQ ID NO: 1510

SEQ ID NO: 1727 - DNA, 201 bp, Homo sapiens; identical to SEQ ID NO: 1511

SEQ ID NO: 1728 - DNA, 201 bp, Homo sapiens; identical to SEQ ID NO: 1512

SEQ ID NO: 1729 - DNA, 201 bp, Homo sapiens; identical to SEQ ID NO: 1513

SEQ ID NO: 1730 - DNA, 201 bp, Homo sapiens; identical to SEQ ID NO: 1514

SEQ ID NO: 1731 - DNA, 201 bp, Homo sapiens; identical to SEQ ID NO: 1515

SEQ ID NO: 1732 - DNA, 201 bp, Homo sapiens; identical to SEQ ID NO: 1516

SEQ ID NO: 1733 - DNA, 201 bp, Homo sapiens; identical to SEQ ID NO: 1517

SEQ ID NO: 1734 - DNA, 201 bp, Homo sapiens; identical to SEQ ID NO: 1518

SEQ ID NO: 1735 - DNA, 201 bp, Homo sapiens; identical to SEQ ID NO: 1519

SEQ ID NO: 1736 - DNA, 201 bp, Homo sapiens; identical to SEQ ID NO: 1520

SEQ ID NO: 1737 - DNA, 201 bp, Homo sapiens; identical to SEQ ID NO: 1521

SEQ ID NO: 1738 - DNA, 201 bp, Homo sapiens; identical to SEQ ID NO: 1522

SEQ ID NO: 1739 - DNA, 201 bp, Homo sapiens; identical to SEQ ID NO: 1523

SEQ ID NO: 1740 - DNA, 201 bp, Homo sapiens; identical to SEQ ID NO: 1524

SEQ ID NO: 1741 - DNA, 201 bp, Homo sapiens; identical to SEQ ID NO: 1525

SEQ ID NO: 1742 - DNA, 201 bp, Homo sapiens; identical to SEQ ID NO: 1526

SEQ ID NO: 1743 - DNA, 187 bp, Homo sapiens; identical to SEQ ID NO: 1527

SEQ ID NO: 1744 - DNA, 201 bp, Homo sapiens; identical to SEQ ID NO: 1528

SEQ ID NO: 1745 - DNA, 201 bp, Homo sapiens; identical to SEQ ID NO: 1529

SEQ ID NO: 1746 - DNA, 186 bp, Homo sapiens; identical to SEQ ID NO: 1530

SEQ ID NO: 1747 - DNA, 183 bp, Homo sapiens; identical to SEQ ID NO: 1531

SEQ ID NO: 1748 - DNA, 182 bp, Homo sapiens; identical to SEQ ID NO: 1532

SEQ ID NO: 1749 - DNA, 201 bp, Homo sapiens; identical to SEQ ID NO: 1533

SEQ ID NO: 1750 - DNA, 201 bp, Homo sapiens; identical to SEQ ID NO: 1534

SEQ ID NO: 1751 - DNA, 201 bp, Homo sapiens; identical to SEQ ID NO: 1535

SEQ ID NO: 1752 - DNA, 201 bp, Homo sapiens; identical to SEQ ID NO: 1536

SEQ ID NO: 1753 - DNA, 201 bp, Homo sapiens; identical to SEQ ID NO: 1537

SEQ ID NO: 1754 - DNA, 201 bp, Homo sapiens; identical to SEQ ID NO: 1538

SEQ ID NO: 1755 - DNA, 153 bp, Homo sapiens; identical to SEQ ID NO: 1539

SEQ ID NO: 1756 - DNA, 201 bp, Homo sapiens; identical to SEQ ID NO: 1540

SEQ ID NO: 1757 - DNA, 152 bp, Homo sapiens; identical to SEQ ID NO: 1541

SEQ ID NO: 1758 - DNA, 129 bp, Homo sapiens
tccctactgaaaataagaatctgaatataaatttgttttctcaaatatttgctatgagaggttgatggattaattaaataagtcaattcctggaatttgaragagcaaataaagacctgagaaccttcc

SEQ ID NO: 1759 - DNA, 133 bp, Homo sapiens
tacttccctactgaaaataagaatctgaatataaatttgttttctcaaatatttgctatgagaggttgatggattaattaaataagtcaattcctggaatktgagagagcaaataaagacctgagaaccttcc

SEQ ID NO: 1760 - DNA, 201 bp, Homo sapiens; identical to SEQ ID NO: 1544

SEQ ID NO: 1761 - DNA, 201 bp, Homo sapiens; identical to SEQ ID NO: 1545

SEQ ID NO: 1762 - DNA, 201 bp, Homo sapiens; identical to SEQ ID NO: 1546

SEQ ID NO: 1763 - DNA, 201 bp, Homo sapiens; identical to SEQ ID NO: 1547

SEQ ID NO: 1764 - DNA, 201 bp, Homo sapiens; identical to SEQ ID NO: 1548

SEQ ID NO: 1765 - DNA, 201 bp, Homo sapiens; identical to SEQ ID NO: 1549

SEQ ID NO: 1766 - DNA, 201 bp, Homo sapiens; identical to SEQ ID NO: 1550

SEQ ID NO: 1767 - DNA, 201 bp, Homo sapiens; identical to SEQ ID NO: 1551

SEQ ID NO: 1768 - DNA, 201 bp, Homo sapiens; identical to SEQ ID NO: 1552

SEQ ID NO: 1769 - DNA, 201 bp, Homo sapiens; identical to SEQ ID NO: 1553

SEQ ID NO: 1770 - DNA, 201 bp, Homo sapiens; identical to SEQ ID NO: 1554

SEQ ID NO: 1771 - DNA, 201 bp, Homo sapiens; identical to SEQ ID NO: 1555

SEQ ID NO: 1772 - DNA, 201 bp, Homo sapiens; identical to SEQ ID NO: 1556

SEQ ID NO: 1773 - DNA, 201 bp, Homo sapiens; identical to SEQ ID NO: 1557

SEQ ID NO: 1774 - DNA, 179 bp, Homo sapiens; identical to SEQ ID NO: 1558

SEQ ID NO: 1775 - DNA, 149 bp, Homo sapiens; identical to SEQ ID NO: 1559

SEQ ID NO: 1776 - DNA, 201 bp, Homo sapiens; identical to SEQ ID NO: 1560

SEQ ID NO: 1777 - DNA, 201 bp, Homo sapiens; identical to SEQ ID NO: 1561

SEQ ID NO: 1778 - DNA, 201 bp, Homo sapiens; identical to SEQ ID NO: 1562

SEQ ID NO: 1779 - DNA, 201 bp, Homo sapiens; identical to SEQ ID NO: 1563

SEQ ID NO: 1780 - DNA, 201 bp, Homo sapiens; identical to SEQ ID NO: 1564

SEQ ID NO: 1781 - DNA, 201 bp, Homo sapiens; identical to SEQ ID NO: 1565

SEQ ID NO: 1782 - DNA, 201 bp, Homo sapiens; identical to SEQ ID NO: 1566

SEQ ID NO: 1783 - DNA, 201 bp, Homo sapiens; identical to SEQ ID NO: 1567

SEQ ID NO: 1784 - DNA, 143 bp, Homo sapiens; identical to SEQ ID NO: 1568

SEQ ID NO: 1785 - DNA, 201 bp, Homo sapiens; identical to SEQ ID NO: 1569

SEQ ID NO: 1786 - DNA, 201 bp, Homo sapiens; identical to SEQ ID NO: 1570

SEQ ID NO: 1787 - DNA, 201 bp, Homo sapiens; identical to SEQ ID NO: 1571

SEQ ID NO: 1788 - DNA, 201 bp, Homo sapiens; identical to SEQ ID NO: 1572

SEQ ID NO: 1789 - DNA, 201 bp, Homo sapiens; identical to SEQ ID NO: 1573

SEQ ID NO: 1790 - DNA, 201 bp, Homo sapiens; identical to SEQ ID NO: 1574

SEQ ID NO: 1791 - DNA, 201 bp, Homo sapiens; identical to SEQ ID NO: 1575

SEQ ID NO: 1792 - DNA, 201 bp, Homo sapiens; identical to SEQ ID NO: 1576

SEQ ID NO: 1793 - DNA, 201 bp, Homo sapiens; identical to SEQ ID NO: 1577

SEQ ID NO: 1794 - DNA, 201 bp, Homo sapiens; identical to SEQ ID NO: 1578

SEQ ID NO: 1795 - DNA, 201 bp, Homo sapiens; identical to SEQ ID NO: 1579

SEQ ID NO: 1796 - DNA, 201 bp, Homo sapiens; identical to SEQ ID NO: 1580

SEQ ID NO: 1797 - DNA, 201 bp, Homo sapiens; identical to SEQ ID NO: 1581

SEQ ID NO: 1798 - DNA, 201 bp, Homo sapiens; identical to SEQ ID NO: 1582

SEQ ID NO: 1799 - DNA, 201 bp, Homo sapiens; identical to SEQ ID NO: 1583

SEQ ID NO: 1800 - DNA, 201 bp, Homo sapiens; identical to SEQ ID NO: 1584

SEQ ID NO: 1801 - DNA, 201 bp, Homo sapiens; identical to SEQ ID NO: 1585

SEQ ID NO: 1802 - DNA, 201 bp, Homo sapiens; identical to SEQ ID NO: 1586

SEQ ID NO: 1803 - DNA, 201 bp, Homo sapiens; identical to SEQ ID NO: 1587

SEQ ID NO: 1804 - DNA, 201 bp, Homo sapiens; identical to SEQ ID NO: 1588

SEQ ID NO: 1805 - DNA, 201 bp, Homo sapiens; identical to SEQ ID NO: 1589

SEQ ID NO: 1806 - DNA, 201 bp, Homo sapiens; identical to SEQ ID NO: 1590

SEQ ID NO: 1807 - DNA, 201 bp, Homo sapiens; identical to SEQ ID NO: 1591

SEQ ID NO: 1808 - DNA, 201 bp, Homo sapiens; identical to SEQ ID NO: 1592

SEQ ID NO: 1809 - DNA, 201 bp, Homo sapiens; identical to SEQ ID NO: 1593

SEQ ID NO: 1810 - DNA, 201 bp, Homo sapiens; identical to SEQ ID NO: 1594

SEQ ID NO: 1811 - DNA, 201 bp, Homo sapiens; identical to SEQ ID NO: 1494

SEQ ID NO: 1812 - DNA, 201 bp, Homo sapiens; identical to SEQ ID NO: 1495

SEQ ID NO: 1813 - DNA, 201 bp, Homo sapiens; identical to SEQ ID NO: 1496

SEQ ID NO: 1814 - DNA, 201 bp, Homo sapiens; identical to SEQ ID NO: 1497

SEQ ID NO: 1815 - DNA, 201 bp, Homo sapiens; identical to SEQ ID NO: 1498

SEQ ID NO: 1816 - DNA, 201 bp, Homo sapiens; identical to SEQ ID NO: 1499

SEQ ID NO: 1817 - DNA, 201 bp, Homo sapiens; identical to SEQ ID NO: 1500

SEQ ID NO: 1818 - DNA, 201 bp, Homo sapiens; identical to SEQ ID NO: 1501

SEQ ID NO: 1819 - DNA, 201 bp, Homo sapiens; identical to SEQ ID NO: 1502

SEQ ID NO: 1820 - DNA, 201 bp, Homo sapiens; identical to SEQ ID NO: 1503

SEQ ID NO: 1821 - DNA, 201 bp, Homo sapiens; identical to SEQ ID NO: 1504

SEQ ID NO: 1822 - DNA, 201 bp, Homo sapiens; identical to SEQ ID NO: 1505

SEQ ID NO: 1823 - DNA, 201 bp, Homo sapiens; identical to SEQ ID NO: 1506

SEQ ID NO: 1824 - DNA, 201 bp, Homo sapiens; identical to SEQ ID NO: 1507

SEQ ID NO: 1825 - DNA, 201 bp, Homo sapiens; identical to SEQ ID NO: 1508

SEQ ID NO: 1826 - DNA, 201 bp, Homo sapiens
cgctgcagcgcgcggatcaggagcagaagtccctgttccccgctcagagactcgaactttccaatgaataggagattatcccagaccccccaaagacacaygtgacccaccaccccatctctgaccatgaggccaccctgaggtgctgggccctgggcttctaccctgcggagatcacactgacctggcagcgggatggcg

SEQ ID NO: 1827 - DNA, 201 bp, Homo sapiens; identical to SEQ ID NO: 1510

SEQ ID NO: 1828 - DNA, 201 bp, Homo sapiens
tcaggagcagaagtccctgttccccgctcagagactcgaactttccaatgaataggagattatcccagaccccccaaagacacacgtgacccaccaccccrtctctgaccatgaggccaccctgaggtgctgggccctgggcttctaccctgcggagatcacactgacctggcagcgggatggcgaggaccaaactcagga

SEQ ID NO: 1829 - DNA, 201 bp, Homo sapiens; identical to SEQ ID NO: 1512

SEQ ID NO: 1830 - DNA, 201 bp, Homo sapiens; identical to SEQ ID NO: 1513

SEQ ID NO: 1831 - DNA, 201 bp, Homo sapiens; identical to SEQ ID NO: 1514

SEQ ID NO: 1832 - DNA, 201 bp, Homo sapiens; identical to SEQ ID NO: 1515

SEQ ID NO: 1833 - DNA, 201 bp, Homo sapiens; identical to SEQ ID NO: 1516

SEQ ID NO: 1834 - DNA, 201 bp, Homo sapiens
cagggctctgatgtgtctctcacagcttgacctgagacagctgtcttgtgagggactgagatgcaggatttcttcacgcctcccctttgtgacttcaagascctctggcatctctttctgcaaaggcacctgaatgtgtctgcgtccctgttagcataatgtgaggaggtggagagacagcccacccttgtgtccactgtg

SEQ ID NO: 1835 - DNA, 201 bp, Homo sapiens; identical to SEQ ID NO: 1518

SEQ ID NO: 1836 - DNA, 201 bp, Homo sapiens; identical to SEQ ID NO: 1519

SEQ ID NO: 1837 - DNA, 201 bp, Homo sapiens
aggctgcgtgcagcgacagtgcccagggctctgatgtgtctctcacagcttgacctgagacagctgtcttgtgagggactgagatgcaggatttcttcackcctcccctttgtgacttcaagagcctctggcatctctttctgcaaaggcacctgaatgtgtctgcgtccctgttagcataatgtgaggaggtggagagac

SEQ ID NO: 1838 - DNA, 201 bp, Homo sapiens; identical to SEQ ID NO: 1521

SEQ ID NO: 1839 - DNA, 201 bp, Homo sapiens
gaaaaggagggagctactctcaggctgcgtgcagcgacagtgcccagggctctgatgtgtctctcacagcttgacctgagacagctgtcttgtgagggacygagatgcaggatttcttcacgcctcccctttgtgacttcaagagcctctggcatctctttctgcaaaggcacctgaatgtgtctgcgtccctgttagcat

SEQ ID NO: 1840 - DNA, 201 bp, Homo sapiens; identical to SEQ ID NO: 1523

SEQ ID NO: 1841 - DNA, 201 bp, Homo sapiens
agtccaccgtccccatcgtgggcattgttgctggcctggctgtcctagcagttgtggtcatcggagctgtggtcgctgctgtgatgtgtaggaggaagagytcaggtggaaaaggagggagctactctcaggctgcgtgcagcgacagtgcccagggctctgatgtgtctctcacagcttgacctgagacagctgtcttgt

SEQ ID NO: 1842 - DNA, 201 bp, Homo sapiens; identical to SEQ ID NO: 1525

SEQ ID NO: 1843 - DNA, 201 bp, Homo sapiens; identical to SEQ ID NO: 1526

SEQ ID NO: 1844 - DNA, 187 bp, Homo sapiens; identical to SEQ ID NO: 1527

SEQ ID NO: 1845 - DNA, 201 bp, Homo sapiens
ctacctggagggcacgtgcgtggagtggctccgcagatacctggagaacgggaaggagacgctgcagcgcgcggatcaggagcagaagtccctgttccccrctcagagactcgaactttccaatgaataggagattatcccagaccccccaaagacacacgtgacccaccaccccatctctgaccatgaggccaccctgag

SEQ ID NO: 1846 - DNA, 201 bp, Homo sapiens; identical to SEQ ID NO: 1528

SEQ ID NO: 1847 - DNA, 201 bp, Homo sapiens; identical to SEQ ID NO: 1529

SEQ ID NO: 1848 - DNA, 186 bp, Homo sapiens; identical to SEQ ID NO: 1530

SEQ ID NO: 1849 - DNA, 183 bp, Homo sapiens; identical to SEQ ID NO: 1531

SEQ ID NO: 1850 - DNA, 182 bp, Homo sapiens; identical to SEQ ID NO: 1532

SEQ ID NO: 1851 - DNA, 201 bp, Homo sapiens
ctgttccccgctcagagactcgaactttccaatgaataggagattatcccagaccccccaaagacacacgtgacccaccaccccatctctgaccatgaggycaccctgaggtgctgggccctgggcttctaccctgcggagatcacactgacctggcagcgggatggcgaggaccaaactcaggacactgagcttgtggag

SEQ ID NO: 1852 - DNA, 201 bp, Homo sapiens; identical to SEQ ID NO: 1534

SEQ ID NO: 1853 - DNA, 201 bp, Homo sapiens; identical to SEQ ID NO: 1535

SEQ ID NO: 1854 - DNA, 201 bp, Homo sapiens; identical to SEQ ID NO: 1536

SEQ ID NO: 1855 - DNA, 201 bp, Homo sapiens; identical to SEQ ID NO: 1537

SEQ ID NO: 1856 - DNA, 201 bp, Homo sapiens; identical to SEQ ID NO: 1538

SEQ ID NO: 1857 - DNA, 153 bp, Homo sapiens; identical to SEQ ID NO: 1539

SEQ ID NO: 1858 - DNA, 201 bp, Homo sapiens
gacggcaaggattacatcgccctgaacgaggacctgagctcctggaccgcggcggacaccgcggctcagatcacccagcgcaagtgggaggcggcccgtgwggcggagcagcagagagcctacctggagggcacgtgcgtggagtggctccgcagatacctggagaacgggaaggagacgctgcagcgcgcggatcaggag

SEQ ID NO: 1859 - DNA, 152 bp, Homo sapiens; identical to SEQ ID NO: 1541

SEQ ID NO: 1860 - DNA, 132 bp, Homo sapiens; identical to SEQ ID NO: 1542

SEQ ID NO: 1861 - DNA, 136 bp, Homo sapiens; identical to SEQ ID NO: 1543

SEQ ID NO: 1862 - DNA, 201 bp, Homo sapiens; identical to SEQ ID NO: 1544

SEQ ID NO: 1863 - DNA, 201 bp, Homo sapiens; identical to SEQ ID NO: 1545

SEQ ID NO: 1864 - DNA, 201 bp, Homo sapiens
ccaccgtccccatcgtgggcattgttgctggcctggctgtcctagcagttgtggtcatcggagctgtggtcgctgctgtgatgtgtaggaggaagagctcwggtggaaaaggagggagctactctcaggctgcgtgcagcgacagtgcccagggctctgatgtgtctctcacagcttgacctgagacagctgtcttgtgag

SEQ ID NO: 1865 - DNA, 201 bp, Homo sapiens
atgggagccgtcttcccagtccaccgtccccatcgtgggcattgttgctggcctggctgtcctagcagttgtggtcatcggagctgtggtcgctgctgtgrtgtgtaggaggaagagctcaggtggaaaaggagggagctactctcaggctgcgtgcagcgacagtgcccagggctctgatgtgtctctcacagcttgacc

SEQ ID NO: 1866 - DNA, 201 bp, Homo sapiens
cggcccgtgtggcggagcagcagagagcctacctggagggcacgtgcgtggagtggctccgcagatacctggagaacgggaaggagacgctgcagcgcgckgatcaggagcagaagtccctgttccccgctcagagactcgaactttccaatgaataggagattatcccagaccccccaaagacacacgtgacccaccacc

SEQ ID NO: 1867 - DNA, 201 bp, Homo sapiens
gtgggaggcggcccgtgtggcggagcagcagagagcctacctggagggcacgtgcgtggagtggctccgcagatacctggagaacgggaaggagacgctgsagcgcgcggatcaggagcagaagtccctgttccccgctcagagactcgaactttccaatgaataggagattatcccagaccccccaaagacacacgtgac

SEQ ID NO: 1868 - DNA, 201 bp, Homo sapiens; identical to SEQ ID NO: 1550

SEQ ID NO: 1869 - DNA, 201 bp, Homo sapiens
cgcaagtgggaggcggcccgtgtggcggagcagcagagagcctacctggagggcacgtgcgtggagtggctccgcagatacctggagaacgggaaggagamgctgcagcgcgcggatcaggagcagaagtccctgttccccgctcagagactcgaactttccaatgaataggagattatcccagaccccccaaagacacac

SEQ ID NO: 1870 - DNA, 201 bp, Homo sapiens; identical to SEQ ID NO: 1552

SEQ ID NO: 1871 - DNA, 201 bp, Homo sapiens
agcgcaagtgggaggcggcccgtgtggcggagcagcagagagcctacctggagggcacgtgcgtggagtggctccgcagatacctggagaacgggaaggasacgctgcagcgcgcggatcaggagcagaagtccctgttccccgctcagagactcgaactttccaatgaataggagattatcccagaccccccaaagacac

SEQ ID NO: 1872 - DNA, 201 bp, Homo sapiens; identical to SEQ ID NO: 1554

SEQ ID NO: 1873 - DNA, 201 bp, Homo sapiens; identical to SEQ ID NO: 1555

SEQ ID NO: 1874 - DNA, 201 bp, Homo sapiens
taggagattatcccagaccccccaaagacacacgtgacccaccaccccatctctgaccatgaggccaccctgaggtgctgggccctgggcttctaccctgsggagatcacactgacctggcagcgggatggcgaggaccaaactcaggacactgagcttgtggagaccagaccagcaggagatagaaccttccagaagtgg

SEQ ID NO: 1875 - DNA, 201 bp, Homo sapiens
ggaaggagacgctgcagcgcgcggatcaggagcagaagtccctgttccccgctcagagactcgaactttccaatgaataggagattatcccagaccccccdaagacacacgtgacccaccaccccatctctgaccatgaggccaccctgaggtgctgggccctgggcttctaccctgcggagatcacactgacctggcagc

SEQ ID NO: 1876 - DNA, 179 bp, Homo sapiens; identical to SEQ ID NO: 1558

SEQ ID NO: 1877 - DNA, 149 bp, Homo sapiens; identical to SEQ ID NO: 1559

SEQ ID NO: 1878 - DNA, 201 bp, Homo sapiens; identical to SEQ ID NO: 1560

SEQ ID NO: 1879 - DNA, 201 bp, Homo sapiens; identical to SEQ ID NO: 1561

SEQ ID NO: 1880 - DNA, 201 bp, Homo sapiens; identical to SEQ ID NO: 1562

SEQ ID NO: 1881 - DNA, 201 bp, Homo sapiens; identical to SEQ ID NO: 1563

SEQ ID NO: 1882 - DNA, 201 bp, Homo sapiens; identical to SEQ ID NO: 1564

SEQ ID NO: 1883 - DNA, 201 bp, Homo sapiens; identical to SEQ ID NO: 1565

SEQ ID NO: 1884 - DNA, 201 bp, Homo sapiens; identical to SEQ ID NO: 1566

SEQ ID NO: 1885 - DNA, 201 bp, Homo sapiens; identical to SEQ ID NO: 1567

SEQ ID NO: 1886 - DNA, 143 bp, Homo sapiens; identical to SEQ ID NO: 1568

SEQ ID NO: 1887 - DNA, 201 bp, Homo sapiens; identical to SEQ ID NO: 1569

SEQ ID NO: 1888 - DNA, 201 bp, Homo sapiens; identical to SEQ ID NO: 1570

SEQ ID NO: 1889 - DNA, 201 bp, Homo sapiens
accgcggcggacaccgcggctcagatcacccagcgcaagtgggaggcggcccgtgtggcggagcagcagagagcctacctggagggcacgtgcgtggagtsgctccgcagatacctggagaacgggaaggagacgctgcagcgcgcggatcaggagcagaagtccctgttccccgctcagagactcgaactttccaatgaa

SEQ ID NO: 1890 - DNA, 201 bp, Homo sapiens; identical to SEQ ID NO: 1572

SEQ ID NO: 1891 - DNA, 201 bp, Homo sapiens; identical to SEQ ID NO: 1573

SEQ ID NO: 1892 - DNA, 201 bp, Homo sapiens; identical to SEQ ID NO: 1574

SEQ ID NO: 1893 - DNA, 201 bp, Homo sapiens; identical to SEQ ID NO: 1575

SEQ ID NO: 1894 - DNA, 201 bp, Homo sapiens; identical to SEQ ID NO: 1576

SEQ ID NO: 1895 - DNA, 201 bp, Homo sapiens
ctgagctcctggaccgcggcggacaccgcggctcagatcacccagcgcaagtgggaggcggcccgtgtggcggagcagcagagagcctacctggagggcahgtgcgtggagtggctccgcagatacctggagaacgggaaggagacgctgcagcgcgcggatcaggagcagaagtccctgttccccgctcagagactcgaa

SEQ ID NO: 1896 - DNA, 201 bp, Homo sapiens; identical to SEQ ID NO: 1578

SEQ ID NO: 1897 - DNA, 201 bp, Homo sapiens
cctgagctcctggaccgcggcggacaccgcggctcagatcacccagcgcaagtgggaggcggcccgtgtggcggagcagcagagagcctacctggagggcvcgtgcgtggagtggctccgcagatacctggagaacgggaaggagacgctgcagcgcgcggatcaggagcagaagtccctgttccccgctcagagactcga

SEQ ID NO: 1898 - DNA, 201 bp, Homo sapiens
cgccctgaacgaggacctgagctcctggaccgcggcggacaccgcggctcagatcacccagcgcaagtgggaggcggcccgtgtggcggagcagcagagarcctacctggagggcacgtgcgtggagtggctccgcagatacctggagaacgggaaggagacgctgcagcgcgcggatcaggagcagaagtccctgttccc

SEQ ID NO: 1899 - DNA, 201 bp, Homo sapiens
tttccaatgaataggagattatcccagaccccccaaagacacacgtgacccaccaccccatctctgaccatgaggccaccctgaggtgctgggccctgggyttctaccctgcggagatcacactgacctggcagcgggatggcgaggaccaaactcaggacactgagcttgtggagaccagaccagcaggagatagaacct

SEQ ID NO: 1900 - DNA, 201 bp, Homo sapiens
tacatcgccctgaacgaggacctgagctcctggaccgcggcggacaccgcggctcagatcacccagcgcaagtgggaggcggcccgtgtggcggagcagckgagagcctacctggagggcacgtgcgtggagtggctccgcagatacctggagaacgggaaggagacgctgcagcgcgcggatcaggagcagaagtccctg

SEQ ID NO: 1901 - DNA, 201 bp, Homo sapiens
ttacatcgccctgaacgaggacctgagctcctggaccgcggcggacaccgcggctcagatcacccagcgcaagtgggaggcggcccgtgtggcggagcagyagagagcctacctggagggcacgtgcgtggagtggctccgcagatacctggagaacgggaaggagacgctgcagcgcgcggatcaggagcagaagtccct

SEQ ID NO: 1902 - DNA, 201 bp, Homo sapiens
caccgcggctcagatcacccagcgcaagtgggaggcggcccgtgtggcggagcagcagagagcctacctggagggcacgtgcgtggagtggctccgcagayacctggagaacgggaaggagacgctgcagcgcgcggatcaggagcagaagtccctgttccccgctcagagactcgaactttccaatgaataggagattat

SEQ ID NO: 1903 - DNA, 201 bp, Homo sapiens
acaccgcggctcagatcacccagcgcaagtgggaggcggcccgtgtggcggagcagcagagagcctacctggagggcacgtgcgtggagtggctccgcagrtacctggagaacgggaaggagacgctgcagcgcgcggatcaggagcagaagtccctgttccccgctcagagactcgaactttccaatgaataggagatta

SEQ ID NO: 1904 - DNA, 201 bp, Homo sapiens
gaccgcggcggacaccgcggctcagatcacccagcgcaagtgggaggcggcccgtgtggcggagcagcagagagcctacctggagggcacgtgcgtggagkggctccgcagatacctggagaacgggaaggagacgctgcagcgcgcggatcaggagcagaagtccctgttccccgctcagagactcgaactttccaatga

SEQ ID NO: 1905 - DNA, 201 bp, Homo sapiens; identical to SEQ ID NO: 1587

SEQ ID NO: 1906 - DNA, 201 bp, Homo sapiens; identical to SEQ ID NO: 1588

SEQ ID NO: 1907 - DNA, 201 bp, Homo sapiens; identical to SEQ ID NO: 1589

SEQ ID NO: 1908 - DNA, 201 bp, Homo sapiens
ggaccgcggcggacaccgcggctcagatcacccagcgcaagtgggaggcggcccgtgtggcggagcagcagagagcctacctggagggcacgtgcgtggabtggctccgcagatacctggagaacgggaaggagacgctgcagcgcgcggatcaggagcagaagtccctgttccccgctcagagactcgaactttccaatg

SEQ ID NO: 1909 - DNA, 201 bp, Homo sapiens; identical to SEQ ID NO: 1591

SEQ ID NO: 1910 - DNA, 201 bp, Homo sapiens; identical to SEQ ID NO: 1592

SEQ ID NO: 1911 - DNA, 201 bp, Homo sapiens; identical to SEQ ID NO: 1593

SEQ ID NO: 1912 - DNA, 201 bp, Homo sapiens; identical to SEQ ID NO: 1594

SEQ ID NO: 1913 - DNA, 201 bp, Homo sapiens
cctcattgtgtgacagcagccatgcctcctcctggggatcaggatctattacctgtgcctggagaggaggggactcctcttctcacccgctggtctctggrcacatactgtccaattcccctgtggcagctgtaatgtgtagttcaatgggcactcatttgtccccttttaagggtaccctcctttagaatccaggacctt

SEQ ID NO: 1914 - DNA, 201 bp, Homo sapiens
ctggggatgttaacatgggattcaggctcaactcacaagaaacttttccatctcatgatggatgctgttgggcatgtccaatgtatgacttcatgagttayacagatgctaattcgtaggggcacttggaatcacatggttgttttgtgtcccatggtcaagcattctatcttatcagggcctacagtaacatgccaaaag

SEQ ID NO: 1915 - DNA, 201 bp, Homo sapiens
caccatgtcctgaaagatggcaccctcccacccgcagagtgcttcctgcaagctggcgttgagctgtgcctatagaagctcttttcaacattctttatggycagcagcccttggttggtgcagatggtgataggaccagtgggtcccacagcatggccacactgcacctccttcgctgtcaagtgggtcccccacgaagat

SEQ ID NO: 1916 - DNA, 201 bp, Homo sapiens
ggttgcgggtcatggagtcccgaaccctcctcctgctgttctcgggagccgtggccctgatccagacctgggcaggtgagtgcggggtcgggagggaaaargcctctgcgggaaggagcgaggggcccgcccggaggagtaaatctgcacatatatttaattacagattacaattacaatcaaggcagaaatgatctcatt

SEQ ID NO: 1917 - DNA, 201 bp, Homo sapiens
caatgggacaaggggaaccaggaggcccccaaggggatccctgggttccacacgaactcctcctaccctcattgtgtgacagcagccatgcctcctcctgkggatcaggatctattacctgtgcctggagaggaggggactcctcttctcacccgctggtctctggacacatactgtccaattcccctgtggcagctgtaa

SEQ ID NO: 1918 - DNA, 201 bp, Homo sapiens
cccctgtggcagctgtaatgtgtagttcaatgggcactcatttgtccccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgtt

SEQ ID NO: 1919 - DNA, 201 bp, Homo sapiens
ccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacct

SEQ ID NO: 1920 - DNA, 201 bp, Homo sapiens
atcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtgcggggtcgggagggaaaaggcctctgcgggaaggagcgaggggcc

SEQ ID NO: 1921 - DNA, 201 bp, Homo sapiens
gattctccccagacgccaaggttgcgggtcatggagtcccgaaccctcctcctgctgttctcgggagccgtggccctgatccagacctgggcaggtgagtrcggggtcgggagggaaaaggcctctgcgggaaggagcgaggggcccgcccggaggagtaaatctgcacatatatttaattacagattacaattacaatca

SEQ ID NO: 1922 - DNA, 201 bp, Homo sapiens
tgtccaatgtatgacttcatgagttacacagatgctaattcgtaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaa

SEQ ID NO: 1923 - DNA, 201 bp, Homo sapiens
gcctcctcctggggatcaggatctattacctgtgcctggagaggaggggactcctcttctcacccgctggtctctggacacatactgtccaattcccctgkggcagctgtaatgtgtagttcaatgggcactcatttgtccccttttaagggtaccctcctttagaatccaggaccttctaccctgcagagtgtggttttg

SEQ ID NO: 1924 - DNA, 201 bp, Homo sapiens
ggggatccctgggttccacacgaactcctcctaccctcattgtgtgacagcagccatgcctcctcctggggatcaggatctattacctgtgcctggagagraggggactcctcttctcacccgctggtctctggacacatactgtccaattcccctgtggcagctgtaatgtgtagttcaatgggcactcatttgtcccct

SEQ ID NO: 1925 - DNA, 201 bp, Homo sapiens
tgggattcaggctcaactcacaagaaacttttccatctcatgatggatgctgttgggcatgtccaatgtatgacttcatgagttacacagatgctaattcktaggggcacttggaatcacatggttgttttgtgtcccatggtcaagcattctatcttatcagggcctacagtaacatgccaaaagttgcttccaacatat

SEQ ID NO: 1926 - DNA, 201 bp, Homo sapiens
gatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgc

SEQ ID NO: 1927 - DNA, 201 bp, Homo sapiens; identical to SEQ ID NO: 1913

SEQ ID NO: 1928 - DNA, 201 bp, Homo sapiens; identical to SEQ ID NO: 1914

SEQ ID NO: 1929 - DNA, 201 bp, Homo sapiens; identical to SEQ ID NO: 1917

SEQ ID NO: 1930 - DNA, 201 bp, Homo sapiens; identical to SEQ ID NO: 1915

SEQ ID NO: 1931 - DNA, 151 bp, Homo sapiens
actcagattctccccagacgccaaggttgcgggtcatggagtcccgaaccstcctcctgctgttctcgggagccgtggccctgatccagacctgggcagattacaattacaatcaaggcagaaatgatctcatttttacattacaactctg

SEQ ID NO: 1932 - DNA, 201 bp, Homo sapiens; identical to SEQ ID NO: 1918

SEQ ID NO: 1933 - DNA, 201 bp, Homo sapiens; identical to SEQ ID NO: 1919

SEQ ID NO: 1934 - DNA, 201 bp, Homo sapiens; identical to SEQ ID NO: 1924

SEQ ID NO: 1935 - DNA, 201 bp, Homo sapiens; identical to SEQ ID NO: 1922

SEQ ID NO: 1936 - DNA, 201 bp, Homo sapiens; identical to SEQ ID NO: 1926

SEQ ID NO: 1937 - DNA, 201 bp, Homo sapiens; identical to SEQ ID NO: 1923

SEQ ID NO: 1938 - DNA, 201 bp, Homo sapiens; identical to SEQ ID NO: 1925

SEQ ID NO: 1939 - DNA, 201 bp, Homo sapiens
atgtcctgaaagatggcaccctcccacccgcaggagtgcttcctgcaagctggcgttgagctgtgcctatagaagctcttttcaacattctttatggtccsggagcccttggttggtgcagatggtgataggacccagtgggtcccacagcatggccacactgcacctccttcgctgtcaagtgggtcccccacgaagata

SEQ ID NO: 1940 - DNA, 201 bp, Homo sapiens
ataggtagcctcatccctgccactgtgtttgctccatttatgtacccacctacccggcctgggctgaccatgggaaggctggctaatttcagtgcttgtgsttggttgttcagggccatttcaggtttgggtgttttctggggatgttaacatgggattcaggctcaactcacaagaaacttttcatctcatgatggatgc

SEQ ID NO: 1941 - DNA, 201 bp, Homo sapiens
gcctcctcctggggatcaggatctattacctgtgcctggagaggaggggactcctcttctcacccgctggtctctggacacatactgtccaattcccctgkggcagctgtaatgtgtagttcaatgggcactcatttgtcccttttaagggtaccctcctttagaatccaggaccttctaccctgcagagtgtggtttggg

SEQ ID NO: 1942 - DNA, 201 bp, Homo sapiens
aggtgagttgaaggaatgggatatggagccacatccacttccaccccttggtatctggacccacgtgttcttcctactgagattacagaactgtagagatrtctttgatttttaaaatgcaccatgtcctgaaagatggcaccctcccacccgcaggagtgcttcctgcaagctggcgttgagctgtgcctatagaagctc

SEQ ID NO: 1943 - DNA, 201 bp, Homo sapiens
gaggaggggactcctcttctcacccgctggtctctggacacatactgtccaattcccctgtggcagctgtaatgtgtagttcaatgggcactcatttgtcycttttaagggtaccctcctttagaatccaggaccttctaccctgcagagtgtggtttggggagagaagtgcaaaatcccacgacaggtgagttgaaggaa

SEQ ID NO: 1944 - DNA, 201 bp, Homo sapiens
aaggatccctgggttccacacgaactcctcctaccctcattgtgtgacagcagccatgcctcctcctggggatcaggatctattacctgtgcctggagagraggggactcctcttctcacccgctggtctctggacacatactgtccaattcccctgtggcagctgtaatgtgtagttcaatgggcactcatttgtccctt

SEQ ID NO: 1945 - DNA, 201 bp, Homo sapiens; identical to SEQ ID NO: 1919

SEQ ID NO: 1946 - DNA, 201 bp, Homo sapiens; identical to SEQ ID NO: 1922

SEQ ID NO: 1947 - DNA, 201 bp, Homo sapiens
tgggattcaggctcaactcacaagaaacttttcatctcatgatggatgctgttgggcatgtccaatgtatgacttcatgagttacacagatgctaattcgkaggggcacttggaatcacatggttgttttgtgtcccatggtcaagcattctatcttatcagggcctacagtaacatgccaaaagttgcttccaacatatt

SEQ ID NO: 1948 - DNA, 201 bp, Homo sapiens
ctggggatgttaacatgggattcaggctcaactcacaagaaacttttcatctcatgatggatgctgttgggcatgtccaatgtatgacttcatgagttacycagatgctaattcgtaggggcacttggaatcacatggttgttttgtgtcccatggtcaagcattctatcttatcagggcctacagtaacatgccaaaagt

SEQ ID NO: 1949 - DNA, 201 bp, Homo sapiens
caccatgtcctgaaagatggcaccctcccacccgcaggagtgcttcctgcaagctggcgttgagctgtgcctatagaagctcttttcaacattctttatgytccaggagcccttggttggtgcagatggtgataggacccagtgggtcccacagcatggccacactgcacctccttcgctgtcaagtgggtcccccacgaa

SEQ ID NO: 1950 - DNA, 201 bp, Homo sapiens
cctcattgtgtgacagcagccatgcctcctcctggggatcaggatctattacctgtgcctggagaggaggggactcctcttctcacccgctggtctctggrcacatactgtccaattcccctgtggcagctgtaatgtgtagttcaatgggcactcatttgtcccttttaagggtaccctcctttagaatccaggaccttc

SEQ ID NO: 1951 - DNA, 201 bp, Homo sapiens
caatgggacaaggggaaccaggaggtccaaggatccctgggttccacacgaactcctcctaccctcattgtgtgacagcagccatgcctcctcctggggakcaggatctattacctgtgcctggagaggaggggactcctcttctcacccgctggtctctggacacatactgtccaattcccctgtggcagctgtaatgtg

SEQ ID NO: 1952 - DNA, 201 bp, Homo sapiens
cccctgtggcagctgtaatgtgtagttcaatgggcactcatttgtcccttttaagggtaccctcctttagaatccaggaccttctaccctgcagagtgtgktttggggagagaagtgcaaaatcccacgacaggtgagttgaaggaatgggatatggagccacatccacttccaccccttggtatctggacccacgtgttc

SEQ ID NO: 1953 - DNA, 201 bp, Homo sapiens
  misc_feature (1)...(201): n = A,T,C or G, or insertion/deletion polymorphism (see Tables 1-2)
ataccattcccgaagaaagatgaggaaacttcgagatcataatgtccgaactccttctaacctagacatcctagagctccacacaagggaggtcctcaaangattagagatgtgtccatgggaagaggcaagtattatctctaaactgaatggaaaattcaacaaacatctccaaccatcctccacagtacctgaatggag

SEQ ID NO: 1954 - DNA, 201 bp, Homo sapiens
aagaaggacaaaaaaggcaaaaatgaagatagaagagagttcaggagtagagggagtggaacatgaagaatctcaaaaaccactgaatgggttttttacamgtgtgaaatcagaactcaggagtagatcatcaggatattctgatatttctgagtcagaagactccggacccgagtgcactgcactgaaaagtatctttac

SEQ ID NO: 1955 - DNA, 201 bp, Homo sapiens; identical to SEQ ID NO: 1954

SEQ ID NO: 1956 - DNA, 161 bp, Homo sapiens
tcagccctctgcctcctcctcaccaagccctcagacagctccaaggccccggctgctccaktgccacacagccgctgccacctctccttagcctccatgttgactacatcccccttgcaggatatcaagaaaccatactgtaatgactgggagagcaggct

SEQ ID NO: 1957 - DNA, 201 bp, Homo sapiens
gaatgagcaagtgaaatccatcaaagaattgggtgaccatgtgaccaagtcacacaagcgtggttactgggattggcctgtccagaagcatcatgacccaygtaaggtagaggagatgtgcaaagccaatgagccctgcacaagctttgcaaagtgtgtgtgtgatgagaattgtgagaaggaagctctgtgcaagtggct

SEQ ID NO: 1958 - DNA, 201 bp, Homo sapiens
cacctctccttagcctccatgttgactacatcccccttgcaggatatcaagaaaccatactgtaatgactgggagagcaggctgaatgcaatggagggtgyattacacttgataaaaaacatgaatcagtcactactggaactgcacaaactggccactgacaaaaatgaccaccactgtgttgacttcattgagacacat

SEQ ID NO: 1959 - DNA, 201 bp, Homo sapiens
aagccctcagacagctccaaggccccggctgctccagtgccacacagccgctgccacctctccttagcctccatgttgactacatcccccttgcaggataycaagaaaccatactgtaatgactgggagagcaggctgaatgcaatggagggtgtattacacttgataaaaaacatgaatcagtcactactggaactgcac

SEQ ID NO: 1960 - DNA, 201 bp, Homo sapiens
cagccaaattctagagcatactcaaggagctgaaaaactggttgctgaacttgaaggagactctcataagtctcatggatcaaccagtcagatgccagagrcccttcaagcttctgatctctggtactgccccgatgggagctttgtcaagaagatcgtaatccgtggccatggcttggacaaacccaaactaggctcctg

SEQ ID NO: 1961 - DNA, 151 bp, Homo sapiens
gaaggtgctggcgatagatcccaaaaaccgggcagcccaggaggaactggggaaggtggtcattcaggggaagaaccaggatgcagggctggctcagggtytgcgcaagatgtttggctgattaaaagttaaaccttaaaagagacaggaa

SEQ ID NO: 1962 - DNA, 201 bp, Homo sapiens
ctcaaggccgagactcctgggagctggagactagcgagaaggaagccctggccagggaagaacgtgcaaggggcacagaactatttcgagctgggaacccygaaggagctgcccgatgctatggacgggctcttcggctgctcctgactttacccccacctggccctccagaacgaactgtccttcatgccaatctggctg

SEQ ID NO: 1963 - DNA, 201 bp, Homo sapiens
ggtctcagaagaatgggaaaggacgagaaaggagtctaaataagaaccctgctattagcattgtttggttttcttttcaggtgctgacctgaacctggttyatccctttctgaccaaaactgttcactcaccgtggaagggactaagcatccatatggagacgccaccagtcaatacaattggagaaaaggacacctctca

SEQ ID NO: 1964 - DNA, 201 bp, Homo sapiens
gacacctctcagccgcaacaagagtgggaaaagaaccttcgggagaaccttgattcagttattcagattaggcagcagccccgagaccctcctaccgaaasgcttgagctggaagtaagcccagatccagccagccaaattctagagcatactcaaggagctgaaaaactggttgctgaacttgaaggagactctcataag

SEQ ID NO: 1965 - DNA, 173 bp, Homo sapiens
agtatctttcccagttgttccgccccctacccccgcctcccgcaccgcgcccctctccggctgccctctccgygtggggcaaggctccgagggcagcattcagtagccatttagctttggaaggagaggtgattcgaatggcccggctcctcctgtcaccatgctaggcactt

SEQ ID NO: 1966 - DNA, 201 bp, Homo sapiens
caaggctccgagggcagcattcagtagccatttagctttggaaggagaggtgattcgaatggcccggctcctcctgtcaccatgctaggcactttggccgygcaggtgctgacctgaacctggttcatccctttctgaccaaaactgttcactcaccgtggaagggactaagcatccatatggagacgccaccagtcaata

SEQ ID NO: 1967 - DNA, 201 bp, Homo sapiens; identical to SEQ ID NO: 1960

SEQ ID NO: 1968 - DNA, 151 bp, Homo sapiens; identical to SEQ ID NO: 1961

SEQ ID NO: 1969 - DNA, 201 bp, Homo sapiens; identical to SEQ ID NO: 1962

SEQ ID NO: 1970 - DNA, 201 bp, Homo sapiens
agccatttagctttggaaggagaggtgattcgaatggcccggctcctcctgtcaccatgctaggcactttggccgcgcaggtgctgacctgaacctggttyatccctttctgaccaaaactgttcactcaccgtggaagggactaagcatccatatggagacgccaccagtcaatacaattggagaaaaggacacctctca

SEQ ID NO: 1971 - DNA, 201 bp, Homo sapiens; identical to SEQ ID NO: 1964

SEQ ID NO: 1972 - DNA, 201 bp, Homo sapiens
cctctccgtgtggggcaaggctccgagggcagcattcagtagccatttagctttggaaggagaggtgattcgaatggcccggctcctcctgtcaccatgcyaggcactttggccgcgcaggtgctgacctgaacctggttcatccctttctgaccaaaactgttcactcaccgtggaagggactaagcatccatatggaga

SEQ ID NO: 1973 - DNA, 201 bp, Homo sapiens
gaagtctttcccctggccatgaaccacctgcatgctacctgtcctacgtccccacccacccgaaaggcacagttgcagctcttggttgcggtctccatgcsgctggcctccaagctgcgtaagactgggcccatgaccattgagaaaatgtgcatctacaccgaccacgctgtctctccctgccagttgcgggactgggag

SEQ ID NO: 1974 - DNA, 168 bp, Homo sapiens
cagcaacttaagctattatgatcctaattttacagatgaggaaaatgaggcacaaagaagtctgtctscgaggcactaaagttcacaagaaatgctaccttgcttcagaaggtttgaagcatttccatgaggccaatgaagactgcatttccaaaggaggaatcctgg

SEQ ID NO: 1975 - DNA, 201 bp, Homo sapiens
gcgagaaaactgtgtcctgttctcccaatcagctcagggcaagtggagtgatgaggcctgtcgcagcagcaagagatacatatgcgagttcaccatccctmaataggtctttctccaatgtgtcctccaagcaagattcatcataacttataggttcatgatctctaagatcaagtaaaaatcataatttttacttattaa

SEQ ID NO: 1976 - DNA, 116 bp, Homo sapiens
cagcaacttaagctaytatgatcctaattttacagatgaggaaaatgaggcacaaagaagtctgtctgcgaggcactaaagttcacaagaaatgctaccttgcttcagaaggtttg

SEQ ID NO: 1977 - DNA, 201 bp, Homo sapiens
aaaaaatcacagtagcaatgcaactcatcactctagaaaagcaagcttaggctacctgaaagattttcccttggaagtttagcgtatgtttgactaacaaraattccctacatcagagactctaggtgctatataatccaaaaacttttcagcctgttgctcattctgtcccatgctggcaataataccttgtcagcccat

SEQ ID NO: 1978 - DNA, 201 bp, Homo sapiens
gagtgagagacaaggatggagatctgaagactcaaattgaaaagctctggacagaagtcaatgccttgaaggaaattcaagccctgcagacagtctgtctscgaggcactaaagttcacaagaaatgctaccttgcttcagaaggtttgaagcatttccatgaggccaatgaagactgcatttccaaaggaggaatcctgg

SEQ ID NO: 1979 - DNA, 201 bp, Homo sapiens; identical to SEQ ID NO: 1975

SEQ ID NO: 1980 - DNA, 201 bp, Homo sapiens; identical to SEQ ID NO: 1977

SEQ ID NO: 1981 - DNA, 201 bp, Homo sapiens
agattccctcctgatccatttacaggacagaaatccccaggttgccaaggcttgcaaaacaacatttcaagcctgttctccatatctgaaactaaaggagraatacagcttccagagtgaagaagatcaaaggaacactaagctctaccagcagctgagccactatcatccagagatcctgcagttcttctacgcaaataa

SEQ ID NO: 1982 - DNA, 201 bp, Homo sapiens
ccctgtgaatttggaagtcatccatgagagtatgaagactctgaccgtcgttctgggcaagatccaggggaaaggtttgggttccttcttcatagatatcrcccttcagaccaggactttattagatgatgagaacgacagtctgagatactcggcctttgttttgtttgggcaattggctgcctttgccgggaggaaatg

SEQ ID NO: 1983 - DNA, 201 bp, Homo sapiens
tcatagatatcacccttcagaccaggactttattagatgatgagaacgacagtctgagatactcggcctttgttttgtttgggcaattggctgcctttgcygggaggaaatggaaaaaatttttcaccagtcaggttaagcagacacgagattccctcctgatccatttacaggacagaaatccccaggttgccaaggctt

SEQ ID NO: 1984 - DNA, 201 bp, Homo sapiens
gccgagtcatcacatttggctactacccgggaaagcagccctcccgagtcaggaacgggctccggttcatcacgtggcagccgcctgcaggagccgcagtyccatggaccaaagacagaggagaatcctgggccagcccctttccatccctacttcccagcccaagcagaaaaggacatcaatgatatctttcttttccaa

SEQ ID NO: 1985 - DNA, 201 bp, Homo sapiens
gactctgaccgtcgttctgggcaagatccaggggaaaggtttgggttccttcttcatagatatcacccttcagaccaggactttattagatgatgagaacracagtctgagatactcggcctttgttttgtttgggcaattggctgcctttgccgggaggaaatggaaaaaatttttcaccagtcaggttaagcagacacg

SEQ ID NO: 1986 - DNA, 201 bp, Homo sapiens
tttaatacttgcgacaaccctgagatagtaagtattattattgttctcattttatagatgagaaagctaacacatagggaaattaggtaactttccccagrtaactcagtaaacagtggagctggaattcaaacatgtacggtctgacttcttgagcccatactcaataatcatgccatcctgcctttccatggaataact

SEQ ID NO: 1987 - DNA, 201 bp, Homo sapiens
ggagaatcctgggccagcccctttccatccctacttcccagcccaagcagaaaaggacatcaatgatatctttcttttccaaggtctcttggaaactgagsttccagaagcgggagcctctgaagaatgtgtttttcatcttggcagaaagagctcgggaccccagtgctaaaaagcgtcacatggcaatgagaaacttgg

SEQ ID NO: 1988 - DNA, 201 bp, Homo sapiens
  misc_feature (1)...(201): n = A,T,C or G, or insertion/deletion polymorphism (see Tables 1-2)
gtatgaagactctgaccgtcgttctgggcaagatccaggggaaaggtttgggttccttcttcatagatatcacccttcagaccaggactttattagatgangagaacgacagtctgagatactcggcctttgttttgtttgggcaattggctgcctttgccgggaggaaatggaaaaaatttttcaccagtcaggttaagc

SEQ ID NO: 1989 - DNA, 201 bp, Homo sapiens
tgagcacagagcaagaagctagccacgctgggctcctcattgcctagctcaggaattcagggctgggaaaatttagccgagtcatcacatttggctactamccgggaaagcagccctcccgagtcaggaacgggctccggttcatcacgtggcagccgcctgcaggagccgcagttccatggaccaaagacagaggagaat

SEQ ID NO: 1990 - DNA, 201 bp, Homo sapiens; identical to SEQ ID NO: 1981

SEQ ID NO: 1991 - DNA, 201 bp, Homo sapiens; identical to SEQ ID NO: 1982

SEQ ID NO: 1992 - DNA, 201 bp, Homo sapiens; identical to SEQ ID NO: 1983

SEQ ID NO: 1993 - DNA, 201 bp, Homo sapiens; identical to SEQ ID NO: 1984

SEQ ID NO: 1994 - DNA, 201 bp, Homo sapiens; identical to SEQ ID NO: 1985

SEQ ID NO: 1995 - DNA, 201 bp, Homo sapiens; identical to SEQ ID NO: 1986

SEQ ID NO: 1996 - DNA, 201 bp, Homo sapiens; identical to SEQ ID NO: 1987

SEQ ID NO: 1997 - DNA, 201 bp, Homo sapiens; identical to SEQ ID NO: 1988
  misc_feature (1)...(201): n = A,T,C or G, or insertion/deletion polymorphism (see Tables 1-2)

SEQ ID NO: 1998 - DNA, 201 bp, Homo sapiens
aatcacagcaaggagaaggaaaaacacctcagcatggcgtggggaagcaaaggaattcagggctgggaaaatttagccgagtcatcacatttggctactamccgggaaagcagccctcccgagtcaggaacgggctccggttcatcacgtggcagccgcctgcaggagccgcagttccatggaccaaagacagaggagaat

SEQ ID NO: 1999 - DNA, 201 bp, Homo sapiens
aggagatagctggaactaaggaaactcccttatttcaaaagatactgcctctctcagaggccaatgaaggaccttccttgggaaatcgggcttgcacaaakccagaaagctctgaggagaggccctataatttgggcttcaggagaaaggtcaatcttaaagcacccacccacaactcagaaaggccgccccaaggctcct

SEQ ID NO: 2000 - DNA, 201 bp, Homo sapiens
tccccagacaaccaggtgcttcctgcccagagtttggccaagggtaagggcaggacatatgggagcaagtatccaggactcatcaaggtggagcaagcccrgtgtggggaggtggctttcaggatggacgaggtggtcagccaggacttcgagggagactatgtggctctcctaggcttttcccaagagagcagaggagag

SEQ ID NO: 2001 - DNA, 201 bp, Homo sapiens
caccaagctactgtcctacctgtgtaccatccccaggcctgaagataaagccaaggggctggcggtcctgattgacgccaggagacagcccccacagcccrgtctggtcagcgccctgcaggccacccaggctcaggtcccagcctctatccgggctattctcttcctgggggagaaggaggcggctctccagctgcagac

SEQ ID NO: 2002 - DNA, 201 bp, Homo sapiens
ctttccttgctgacctccaccaggcctcttccctgctacaagcttccatcgaggaattcgagaaggccgacccccctggggggatgcaggaggctaccagrtgcctgagcaagtccaaggagctgatggaggctgtgctgagggaccccggcctactgggcctccagcgggaaggtggagccaccctggccaggctgcagc

SEQ ID NO: 2003 - DNA, 201 bp, Homo sapiens
ggcccggatcaggcatgaggagatccggatgctcctggagaaggcactgacccacagctcttgcccagaggctccagctgctcactcagcgcgcccagaaygaagaggggtggcagccaagggccagggtgtgagtgtagaggtcacttccaaggggaggtgggatcagcctccactagactcactgggcatggaccattt

SEQ ID NO: 2004 - DNA, 104 bp, Homo sapiens
atgaggatttaaggatcagtgtgtttggtgctgatccaggaacctctgctgggggagtaggaggcgaatctgcaaagggaataaagagtatgttgtcaagmaaa

SEQ ID NO: 2005 - DNA, 201 bp, Homo sapiens
actcagcgcgcccagaacgaagaggggtggcagccaagggccagggtgtgagtgtagaggtcacttccaaggggaggtgggatcagcctccactagactcrctgggcatggaccatttgccaaagtcctattggcctcctgggccccccagaggggaacagaacagaactttccaggcaggctctccaccccaggaagctg

SEQ ID NO: 2006 - DNA, 201 bp, Homo sapiens
tgagaagctcgcagccgtggggctgcaggtggcctccctgagccgggcaggcctgggccaggagctatgggaggaggcccggatcaggcatgaggagatcyggatgctcctggagaaggcactgacccacagctcttgcccagaggctccagctgctcactcagcgcgcccagaacgaagaggggtggcagccaagggcca

SEQ ID NO: 2007 - DNA, 201 bp, Homo sapiens
ggggcctgggaggcaccatggtgcacagtttcagaggtcaccaagctactgtcctacctgtgtaccatccccaggcctgaagataaagccaaggggctggyggtcctgattgacgccaggagacagcccccacagcccggtctggtcagcgccctgcaggccacccaggctcaggtcccagcctctatccgggctattctc

SEQ ID NO: 2008 - DNA, 201 bp, Homo sapiens
ccagctggaggggtagctgggagctctggtcagtcccagtgagacgtcaccatggagcactggttttacattctgcctctgctgggaggatgagaactgtygacctgcccctggctccagaaaactcctggaagacccgatcctcacccatgcagaatagcaagagtgggcgtcagaaccagggcacaataaatggtgtga

SEQ ID NO: 2009 - DNA, 201 bp, Homo sapiens
gacgtcaccatggagcactggttttacattctgcctctgctgggaggatgagaactgttgacctgcccctggctccagaaaactcctggaagacccgatcytcacccatgcagaatagcaagagtgggcgtcagaaccagggcacaataaatggtgtgattggctccatccctccaggctctcattgtggaaagacctgtc

SEQ ID NO: 2010 - DNA, 201 bp, Homo sapiens
acttctacctccaagtggagccccaggaggagcagtctgtctgcatcatgatcaaatgcctctccctggacctctgcacagtggacaagaagcctgttccmgagccagcctaccctatacttttcacccaagaatggctggaggccatcaacagtgactttgagggaaatcccctacacaactgcttggtagcatcagaaa

SEQ ID NO: 2011 - DNA, 201 bp, Homo sapiens
ttgggcttcaggagaaaggtcaatcttaaagcacccacccacaactcagaaaggccgccccaaggctcctacatgaatgtccttgaggacgcactggactstgcctctggtctcagggcaggtgtctcacaagagccagctgcctccaagatgcagggacctctaggaaacccagagaatatggtgcagctcaggcctgga

SEQ ID NO: 2012 - DNA, 201 bp, Homo sapiens
tcgaggaattcgagaaggccgacccccctggggggatgcaggaggctaccaggtgcctgagcaagtccaaggagctgatggaggctgtgctgagggacccsggcctactgggcctccagcgggaaggtggagccaccctggccaggctgcagcatgatgccagcaggctggacttcagccctgatgtcaggagccatctgg

SEQ ID NO: 2013 - DNA, 201 bp, Homo sapiens
ctccagcacaatgggccctggaaagtcctgtgttccctctactctcctaaacccaaccgagccaaatctttggggaaagctggaacaactcagaccaaaayatctggcccagccactgcccccagcccactgactgaggaaaaggctgccttgccagaagcttctgcaggctccccagaaagaggccccaccctggaggag

SEQ ID NO: 2014 - DNA, 201 bp, Homo sapiens
ggccctataatttgggcttcaggagaaaggtcaatcttaaagcacccacccacaactcagaaaggccgccccaaggctcctacatgaatgtccttgaggaygcactggactgtgcctctggtctcagggcaggtgtctcacaagagccagctgcctccaagatgcagggacctctaggaaacccagagaatatggtgcagc

SEQ ID NO: 2015 - DNA, 201 bp, Homo sapiens
cgtcctgggtcaggtgttccgtctcctggactctggcttccagggggatgggctgagcttccttctggatttcctgatccctgccaagcgcctgtgtgagmaagtgcgagaagcagcctgtgctccctactcacactgcctcttcttacacgagggctggccactctgtctgagggatgaagttgtggtccacttggcacc

SEQ ID NO: 2016 - DNA, 201 bp, Homo sapiens
tgccaggttccaggggattcaagcaggaggtggtagggagggagctgggggccccagagcatcttcagctgctgttgggtggaggtggccgggacagggcygggcggcccctgcttctggtgtcaactacagagggggcctgggaggcaccatggtgcacagtttcagaggtcaccaagctactgtcctacctgtgtacca

SEQ ID NO: 2017 - DNA, 201 bp, Homo sapiens
gccgctcagctgggagctacagccagaggggctggggaggcagaacgtgcagagttcccagagctggcagcctttgcctctacccagcgggccttccaggmtgagctgacccacttttacatggcggccgagcggcaacgcacggacctcgagacgctgctccacctgcaccgcttctgcaagaggatgacctggttccac

SEQ ID NO: 2018 - DNA, 201 bp, Homo sapiens
cgctcagctgggagctacagccagaggggctggggaggcagaacgtgcagagttcccagagctggcagcctttgcctctacccagcgggccttccaggctragctgacccacttttacatggcggccgagcggcaacgcacggacctcgagacgctgctccacctgcaccgcttctgcaagaggatgacctggttccacat

SEQ ID NO: 2019 - DNA, 201 bp, Homo sapiens
gaggggctggggaggcagaacgtgcagagttcccagagctggcagcctttgcctctacccagcgggccttccaggctgagctgacccacttttacatggcrgccgagcggcaacgcacggacctcgagacgctgctccacctgcaccgcttctgcaagaggatgacctggttccacatggactgtcaggacctgatggccc

SEQ ID NO: 2020 - DNA, 201 bp, Homo sapiens; identical to SEQ ID NO: 1999

SEQ ID NO: 2021 - DNA, 201 bp, Homo sapiens; identical to SEQ ID NO: 2000

SEQ ID NO: 2022 - DNA, 201 bp, Homo sapiens; identical to SEQ ID NO: 2001

SEQ ID NO: 2023 - DNA, 201 bp, Homo sapiens; identical to SEQ ID NO: 2002

SEQ ID NO: 2024 - DNA, 201 bp, Homo sapiens; identical to SEQ ID NO: 2003

SEQ ID NO: 2025 - DNA, 104 bp, Homo sapiens; identical to SEQ ID NO: 2004

SEQ ID NO: 2026 - DNA, 201 bp, Homo sapiens; identical to SEQ ID NO: 2005

SEQ ID NO: 2027 - DNA, 201 bp, Homo sapiens; identical to SEQ ID NO: 2006

SEQ ID NO: 2028 - DNA, 201 bp, Homo sapiens; identical to SEQ ID NO: 2007

SEQ ID NO: 2029 - DNA, 201 bp, Homo sapiens; identical to SEQ ID NO: 2008

SEQ ID NO: 2030 - DNA, 201 bp, Homo sapiens; identical to SEQ ID NO: 2009

SEQ ID NO: 2031 - DNA, 201 bp, Homo sapiens; identical to SEQ ID NO: 2010

SEQ ID NO: 2032 - DNA, 201 bp, Homo sapiens; identical to SEQ ID NO: 2011

SEQ ID NO: 2033 - DNA, 201 bp, Homo sapiens; identical to SEQ ID NO: 2012

SEQ ID NO: 2034 - DNA, 201 bp, Homo sapiens; identical to SEQ ID NO: 2013

SEQ ID NO: 2035 - DNA, 201 bp, Homo sapiens; identical to SEQ ID NO: 2014

SEQ ID NO: 2036 - DNA, 201 bp, Homo sapiens; identical to SEQ ID NO: 2015

SEQ ID NO: 2037 - DNA, 201 bp, Homo sapiens
tggaggaggagcccccagggcctgagcccaggattggggctctaggtgtcaaggttttccgctccaggatagcatgcctgccaggtggccgggacagggcygggcggcccctgcttctggtgtcaactacagagggggcctgggaggcaccatggtgcacagtttcagaggtcaccaagctactgtcctacctgtgtacca

SEQ ID NO: 2038 - DNA, 201 bp, Homo sapiens; identical to SEQ ID NO: 2017

SEQ ID NO: 2039 - DNA, 201 bp, Homo sapiens; identical to SEQ ID NO: 2018

SEQ ID NO: 2040 - DNA, 201 bp, Homo sapiens; identical to SEQ ID NO: 2019

SEQ ID NO: 2041 - DNA, 201 bp, Homo sapiens
gagtggggatggggcctcagggcacctccctacgctggcaggaggctaccaggtgcctgagcaagtccaaggagctgatggaggctgtgctgagggacccsggcctactgggcctccagcgggaaggtggagccaccctggccaggctgcagcatgatgccagcaggctggacttcagccctgatgtcaggagccatctgg

SEQ ID NO: 2042 - DNA, 201 bp, Homo sapiens
tagggggagccagagggcagcagggagatcagcgaagaggctggaatgggtgtcccagcaagagatgctggagggtggaccaatgaggttgccgtggtgaygagaggggacatggctagaggggatgttttagagacagaaatgacagactttctggaggaccttgaatgccaaactgggagttggacttgatctgggtgt

SEQ ID NO: 2043 - DNA, 201 bp, Homo sapiens
agttggacttgatctgggtgtggggagccttggaaggttgcagagggagagtggggatggggcctcagggcacctccctacgctggcaggaggctaccagrtgcctgagcaagtccaaggagctgatggaggctgtgctgagggaccccggcctactgggcctccagcgggaaggtggagccaccctggccaggctgcagc

SEQ ID NO: 2044 - DNA, 201 bp, Homo sapiens
gaggccgcccgggtgtttcatgcttttcgctggttattacatcttgcgtttctctgttgttatgtctgaaaccgtgcctgcagcttctgccagtgctggtstagccgctatggagaaacttccaaccaagaagcgagggaggaagccggctggcttgataagtgcaagtcgcaaagtgccgaacctctctgtgtccaagtt

SEQ ID NO: 2045 - DNA, 201 bp, Homo sapiens
  misc_feature (1)...(201): n = A,T,C or G, or insertion/deletion polymorphism (see Tables 1-2)
gaaacttccaaccaagaagcgagggaggaagccggctggcttgataagtgcaagtcgcaaagtgccgaacctctctgtgtccaagttgatcaccgaggccntttcagtgtcacaggaacgagtaggtatgtctttggttgcgctcaagaaggcattggccgctgctggctacgacgtagagaagaataacagccgcatcaa

SEQ ID NO: 2046 - DNA, 201 bp, Homo sapiens
gcagcttctgccagtgctggtctagccgctatggagaaacttccaaccaagaagcgagggaggaagccggctggcttgataagtgcaagtcgcaaagtgcygaacctctctgtgtccaagttgatcaccgaggccctttcagtgtcacaggaacgagtaggtatgtctttggttgcgctcaagaaggcattggccgctgct

SEQ ID NO: 2047 - DNA, 201 bp, Homo sapiens
acaagggaatcctggtgcaaaccaggggtactggtgcttccggttcctttaagcttagtaagaaggtgattcctaaatctaccagaagcaaggctaaaaartcagtttctgccaagaccaagaagctggttttatccagggactccaagtcaccaaagactgctaaaaccaataagagagccaagaagccgagagcgacaa

SEQ ID NO: 2048 - DNA, 201 bp, Homo sapiens
gttattacatcttgcgtttctctgttgttatgtctgaaaccgtgcctgcagcttctgccagtgctggtctagccgctatggagaaacttccaaccaagaarcgagggaggaagccggctggcttgataagtgcaagtcgcaaagtgccgaacctctctgtgtccaagttgatcaccgaggccctttcagtgtcacaggaac

SEQ ID NO: 2049 - DNA, 201 bp, Homo sapiens
gctggttttatccagggactccaagtcaccaaagactgctaaaaccaataagagagccaagaagccgagagcgacaactcctaaaactgttaggagcgggwgaaaggctaaaggagccaagggtaagcaacagcagaagagcccagtgaaggcaagggcttcgaagtcaaaattgacccaacatcatgaagttaatgttag

SEQ ID NO: 2050 - DNA, 201 bp, Homo sapiens
gtaaaacaaacacaaatactcctcctccaaggggcgggggcggtgcctaggtgatgcaccaatcacagcgcgccctaccctatataaggccccgaggccgyccgggtgtttcatgcttttcgctggttattacatcttgcgtttctctgttgttatgtctgaaaccgtgcctgcagcttctgccagtgctggtctagccgc

SEQ ID NO: 2051 - DNA, 201 bp, Homo sapiens
caaggctaaaaagtcagtttctgccaagaccaagaagctggttttatccagggactccaagtcaccaaagactgctaaaaccaataagagagccaagaagycgagagcgacaactcctaaaactgttaggagcgggagaaaggctaaaggagccaagggtaagcaacagcagaagagcccagtgaaggcaagggcttcgaa

SEQ ID NO: 2052 - DNA, 201 bp, Homo sapiens
ggcaagggcttcgaagtcaaaattgacccaacatcatgaagttaatgttagaaaggccacatctaagaagtaaagagctttccgggaggccaatttggaargaacccaaaggctcttttaagagccacccacattattttaagatggcgtaacactggaaacaagtttctgtgacagttatctataggtttaagttgtgat

SEQ ID NO: 2053 - DNA, 201 bp, Homo sapiens
atggagaaacttccaaccaagaagcgagggaggaagccggctggcttgataagtgcaagtcgcaaagtgccgaacctctctgtgtccaagttgatcaccgrggccctttcagtgtcacaggaacgagtaggtatgtctttggttgcgctcaagaaggcattggccgctgctggctacgacgtagagaagaataacagccgc

SEQ ID NO: 2054 - DNA, 201 bp, Homo sapiens
aaagactgctaaaaccaataagagagccaagaagccgagagcgacaactcctaaaactgttaggagcgggagaaaggctaaaggagccaagggtaagcaamagcagaagagcccagtgaaggcaagggcttcgaagtcaaaattgacccaacatcatgaagttaatgttagaaaggccacatctaagaagtaaagagcttt

SEQ ID NO: 2055 - DNA, 201 bp, Homo sapiens
gagttgaaaaggcttgagattggagaattaattcaggccaggcttcaagaccatcctgggcaacatagccagactaccatctataccaggggtcctcattyccccggccaccgaccggtaaccggtccctgtccatggcacgttatgaattgagccgcacagctgaggggtgagcgaacattaaccaactgagctccaccg

SEQ ID NO: 2056 - DNA, 201 bp, Homo sapiens
ccatggcacgttatgaattgagccgcacagctgaggggtgagcgaacattaaccaactgagctccaccgcctgtcaggttagctgcagcattagatagatwctcataagctcaaactgtattgtgaatggcacatgcaagggatctaggtttcaggctccttgtgacaatctaatgcctgatgatctgaggttggagcagt

SEQ ID NO: 2057 - DNA, 119 bp, Homo sapiens
tcttttaagagccacccastagccgctatggagaaacttccaaccaagaagcgagggaggaagccggctggcttgataagtgcaagtcgcaaagtgccgaacctctctgtgtccaagtt

SEQ ID NO: 2058 - DNA, 201 bp, Homo sapiens; identical to SEQ ID NO: 2045
  misc_feature (1)...(201): n = A,T,C or G, or insertion/deletion polymorphism (see Tables 1-2)

SEQ ID NO: 2059 - DNA, 201 bp, Homo sapiens; identical to SEQ ID NO: 2047

SEQ ID NO: 2060 - DNA, 201 bp, Homo sapiens; identical to SEQ ID NO: 2054

SEQ ID NO: 2061 - DNA, 201 bp, Homo sapiens; identical to SEQ ID NO: 2049

SEQ ID NO: 2062 - DNA, 201 bp, Homo sapiens; identical to SEQ ID NO: 2051

SEQ ID NO: 2063 - DNA, 201 bp, Homo sapiens; identical to SEQ ID NO: 2053

SEQ ID NO: 2064 - DNA, 201 bp, Homo sapiens
gcagcttctgccagtgctggtgtagccgctatggagaaacttccaaccaagaagcgagggaggaagccggctggcttgataagtgcaagtcgcaaagtgcygaacctctctgtgtccaagttgatcaccgaggccctttcagtgtcacaggaacgagtaggtatgtctttggttgcgctcaagaaggcattggccgctgct

SEQ ID NO: 2065 - DNA, 201 bp, Homo sapiens
gttattacatcttgcgtttctctgttgttatgtctgaaaccgtgcctgcagcttctgccagtgctggtgtagccgctatggagaaacttccaaccaagaarcgagggaggaagccggctggcttgataagtgcaagtcgcaaagtgccgaacctctctgtgtccaagttgatcaccgaggccctttcagtgtcacaggaac

SEQ ID NO: 2066 - DNA, 201 bp, Homo sapiens
acctggccacagatgtgacttgtgtggggccaggagcacacaagggccaaagtgtgatctccctggatctgtacacctgtgagttagatctgactaacctrattctgttctcactttccatatctgtatctctctttctcatggtgatgatgacagcaagtcacctctatttctgggatgtgtggtatatttaccatttct

SEQ ID NO: 2067 - DNA, 201 bp, Homo sapiens
acatcaacaaactccaggaactggatctgtcccaaaacttcttggccaaagaaattggggatgctaaatttctgcattttctccccagcctcatccaattrgatctgtctttcaattttgaacttcaggtctatcgtgcatctatgaatctatcacaagcattttcttcactgaaaagcctgaaaattctgcggatcagag

SEQ ID NO: 2068 - DNA, 201 bp, Homo sapiens
tggagagtgagtctcttagaactctggaattcagaggaaatcacttagatgttttatggagagaaggtgataacagatacttacaattattcaagaatctrctaaaattagaggaattagacatctctaaaaattccctaagtttcttgccttctggagtttttgatggtatgcctccaaatctaaagaatctctctttgg

SEQ ID NO: 2069 - DNA, 201 bp, Homo sapiens
agcatgtttaaacaatttaaaagactgaaagtcatagatctttcagtgaataaaatatcaccttcaggagattcaagtgaagttggcttctgctcaaatgycagaacttctgtagaaagttatgaaccccaggtcctggaacaattacattatttcagatatgataagtatgcaaggagttgcagattcaaaaacaaagag

SEQ ID NO: 2070 - DNA, 201 bp, Homo sapiens
cttaaccaattgcttccgtgtcatccagggccccattctgtgcagattgagtgtgggcaccacacaggtggttgctgcttcagtgcttcctgctctttttscttgggcctgcttctgggttccatagggaaacagtaagaaagaaagacacatccttaccataaatgcatatggtccacctacaaatagaaaaatatttaa

SEQ ID NO: 2071 - DNA, 201 bp, Homo sapiens
cagaaaatgtcctcaacaatctgaagatgttgcttttgcatcataatcggtttctgtgcacctgtgatgctgtgtggtttgtctggtgggttaaccatacrgaggtgactattccttacctggccacagatgtgacttgtgtggggccaggagcacacaagggccaaagtgtgatctccctggatctgtacacctgtgagt

SEQ ID NO: 2072 - DNA, 201 bp, Homo sapiens
tcttggcacctctcatgctctgctctcttcaaccagacctctacattccattttggaagaagactaaaaatggtgtttccaatgtggacactgaagagacwaattcttatcctttttaacataatcctaatttccaaactccttggggctagatggtttcctaaaactctgccctgtgatgtcactctggatgttccaaag

SEQ ID NO: 2073 - DNA, 201 bp, Homo sapiens
ttagtgttctgtttgttgtcattccaccagcactcatctccatctcctatggcttcataactcaagctgtgctgaggatcaaatcagtagaggcaaggcayaaagccttcagcacctgctcctcccaccttacagtggtgattatattctatggcaccataatctacgtgtacctgcaacctagtgacagctatgcccagg

SEQ ID NO: 2074 - DNA, 201 bp, Homo sapiens
gaattggtgctttttgttgttagtgttctgtttgttgtcattccaccagcactcatctccatctcctatggcttcataactcaagctgtgctgaggatcawatcagtagaggcaaggcacaaagccttcagcacctgctcctcccaccttacagtggtgattatattctatggcaccataatctacgtgtacctgcaacct

SEQ ID NO: 2075 - DNA, 201 bp, Homo sapiens
ttgtgggatgggggactgggggagggatagcgttaggagaaatacctaatgtaaatgacgagttgataggtgcagcaaaccaacatggcacatctcatgtrttctgttattctaaatttaattgttttggatgtacccattccattcctgccttaggtgcggatccccctggagggatgggattgggcaatgagagttccc

SEQ ID NO: 2076 - DNA, 201 bp, Homo sapiens
ttgctcctcagaccttagttaacttgcaaagaccaaagaagacgatcacttacggtggttgtgtggcgcaactctatatttctctggcactgggctccackgaatgtatcctcttggctgacatggccttggatcggtacattgctgtctgcaaacccctccactatgtagtcatcatgaacccacggctttgccaacagc

SEQ ID NO: 2077 - DNA, 201 bp, Homo sapiens
cctggctcagtggtttggctagttccctaatccatgcaacttttaccttgcaattgcctctctgtggcaaccataggctggaccattttatttgcgaagtwccagctcttctcaagttggcttgtgtggacaccactgtcaatgaattggtgctttttgttgttagtgttctgtttgttgtcattccaccagcactcatct

SEQ ID NO: 2078 - DNA, 201 bp, Homo sapiens
ggcatctatctcctggctcagtggtttggctagttccctaatccatgcaacttttaccttgcaattgcctctctgtggcaaccataggctggaccattttrtttgcgaagtaccagctcttctcaagttggcttgtgtggacaccactgtcaatgaattggtgctttttgttgttagtgttctgtttgttgtcattccacc

SEQ ID NO: 2079 - DNA, 166 bp, Homo sapiens
aatctacgtgtacctgcaacctagtgacagctatgcccaggaccaagggaagtttatctccctcttctacaccatggtgacccccactttaaatcctatcrtctatactttaaggaacaaggatatgaaagaggctctgaggaaacttctctcgggaaaattgtga

SEQ ID NO: 2080 - DNA, 201 bp, Homo sapiens
tatctcctggctcagtggtttggctagttccctaatccatgcaacttttaccttgcaattgcctctctgtggcaaccataggctggaccattttatttgcraagtaccagctcttctcaagttggcttgtgtggacaccactgtcaatgaattggtgctttttgttgttagtgttctgtttgttgtcattccaccagcact

SEQ ID NO: 2081 - DNA, 201 bp, Homo sapiens
tgttctctttgtatttgtccttttcttctacctcctgacccttgtgggaaacttcaccataatcatcatctcatatctggatccccctcttcataccccartgtacttttttctcagcaacctctctttactggacatctgcttcactactagccttgctcctcagaccttagttaacttgcaaagaccaaagaagacgat

SEQ ID NO: 2082 - DNA, 132 bp, Homo sapiens
gcccaggaccaagggaagtttatctccctcttctacaccatggtgacccccactttaaatcctatcatctatactttaaggaacaaggatatgaaagaggmtctgaggaaacttctctcgggaaaattgtga

SEQ ID NO: 2083 - DNA, 201 bp, Homo sapiens
cctcccggctgtgatgtcctgtgaccgctatgtggctgtctgccgtcctctccattacactgtcttaatgcatatccatctctgcatggccttggcatctrtggcatggctcagtggaatagccaccaccctggtacagtccaccctcaccctgcagctgcccttctgtgggcatcgccaagtggatcatttcatctgcga

SEQ ID NO: 2084 - DNA, 201 bp, Homo sapiens
cctgttgtgggatgggggactgggggagggatagcgttaggagaaatacctaatgtaaatgacgagttgataggtgcagcaaaccaacatggcacatctcrtgtgttctgttattctaaatttaattgttttggatgtacccattccattcctgccttaggtgcggatccccctggagggatgggattgggcaatgagagt

SEQ ID NO: 2085 - DNA, 201 bp, Homo sapiens
cattacactgtcttaatgcatatccatctctgcatggccttggcatctatggcatggctcagtggaatagccaccaccctggtacagtccaccctcacccygcagctgcccttctgtgggcatcgccaagtggatcatttcatctgcgaggtccctgtgctcatcaagctggcttgtgtgggcaccacgtttaacgaggct

SEQ ID NO: 2086 - DNA, 201 bp, Homo sapiens
aaacctgtgggaacccatgaaaactatcgcctatggtggctgtttggttcacctttacaactcccatgccctgggatccactgagtgcgtcctcccggctstgatgtcctgtgaccgctatgtggctgtctgccgtcctctccattacactgtcttaatgcatatccatctctgcatggccttggcatctatggcatggct

SEQ ID NO: 2087 - DNA, 149 bp, Homo sapiens
aatgagagcaacctagcaggtttcatccttttagggttttctgattatsctcagttacagaaggttctatttgtgctcatattgattctgtatttactaactattttggggaataccaccatcattctggtttctcgtctggaacccaa

SEQ ID NO: 2088 - DNA, 201 bp, Homo sapiens
ccattccattcctgccttaggtgcggatccccctggagggatgggattgggcaatgagagttccctaatggatttcatccttctaggcttctcagaccacyctcgtctggaggctgttctctttgtatttgtccttttcttctacctcctgacccttgtgggaaacttcaccataatcatcatctcatatctggatccccc

SEQ ID NO: 2089 - DNA, 201 bp, Homo sapiens
tgtgctgaggatcaaatcagtagaggcaaggcacaaagccttcagcacctgctcctcccaccttacagtggtgattatattctatggcaccataatctacrtgtacctgcaacctagtgacagctatgcccaggaccaagggaagtttatctccctcttctacaccatggtgacccccactttaaatcctatcatctatac

SEQ ID NO: 2090 - DNA, 201 bp, Homo sapiens
ctcaccctgcagctgcccttctgtgggcatcgccaagtggatcatttcatctgcgaggtccctgtgctcatcaagctggcttgtgtgggcaccacgtttamcgaggctgagctttttgtggctagtatccttttccttatagtgcctgtctcattcatcctggtctcctctggctacattgcccacgcagtgttgaggatt

SEQ ID NO: 2091 - DNA, 201 bp, Homo sapiens
ttttgtggctagtatccttttccttatagtgcctgtctcattcatcctggtctcctctggctacattgcccacgcagtgttgaggattaagtcagctaccrggagacagaaagcattcgggacctgcttctcccacctgacagtggtcaccatcttttatggaaccatcatcttcatgtatctgcagccagccaagagtag

SEQ ID NO: 2092 - DNA, 201 bp, Homo sapiens
atacaggcgaaaaaccttataaatgtgacaagtgtgggaagggctttagtcagagctccaaactgcacatccaccagcgagtccacactggagagaagccytatgagtgtgaggagtgtggtatgagcttcagtcagcgctcaaacctgcacatccaccagcgagtacacacaggagagaggccctacaagtgtggtgagt

SEQ ID NO: 2093 - DNA, 201 bp, Homo sapiens
gcctgaactagatatttccccttgtcaacagtggggagaagcatcttctcctatttccagaaacagggacagtgtgatgactcttcaaagtggttgtttcraaaacattgaaagtgaaacatatttgcctttgaaagtctcaagccaaatagacacacaagactcttcagtgaagttctgtaagaatgagcctcaggatca

SEQ ID NO: 2094 - DNA, 201 bp, Homo sapiens
agaagccctatgagtgtgaggagtgtggtatgagcttcagtcagcgctcaaacctgcacatccaccagcgagtacacacaggagagaggccctacaagtgwggtgagtgtgggaagggcttcagtcagagctcgaaccttcacattcaccggtgcatccacacaggagagaagccttaccaatgctatgagtgtgggaagg

SEQ ID NO: 2095 - DNA, 201 bp, Homo sapiens
atttaagtatcaagcactttgttatgctgtacaatgaatggattgttcttgtttctcagatgggtagagtaaaagtgtctgtactttacaattcaactacwtgttctacccagcattttaacggcaagaactttatatttattctcaagcagggcatgtttccctttgttcacattctctgagaaattgaaactctggttt

SEQ ID NO: 2096 - DNA, 128 bp, Homo sapiens
actttacaattcaactacttgttctacccagcattttaacggcaagaactttatatttattctcaagcagggcatgtttccctttgttcacattctctgakaaattgaaactctggtttctcttcaaa

SEQ ID NO: 2097 - DNA, 201 bp, Homo sapiens
  misc_feature (1)...(201): n = A,T,C or G, or insertion/deletion polymorphism (see Tables 1-2)
ggagaaaccctgtgaccataataactgtgggaaaatacttaacaccagcccagatggtcatccatatgagaaaatccacactgcagagaaacaatacgaangtagtcagtgtggtaagaacttcagtcaaagctcagagctactacttcatcagagagaccacacagaagaaaaaccctacaaatgtgagcaatgtgggaa

SEQ ID NO: 2098 - DNA, 201 bp, Homo sapiens
ctggactctgctcccaggaagctgtgcggagctgtgatgctgggcaactacagaaacttggtcttggagacttgaatgaaaattctgtggagaatcttcarcagaaaacacttcaggatctgttacatgagctttcctcctggctagttttggaaggcatggccagtacaattactggaagtcaggattgtattgtgaatc

SEQ ID NO: 2099 - DNA, 201 bp, Homo sapiens
cagaatggccagttaaaagaatctttggatcccattgactgtaactgcaaagacattcatggatggaaatcacaggtggtcagttgtagtcagcagagagstcatacagaggagaaaccctgtgaccataataactgtgggaaaatacttaacaccagcccagatggtcatccatatgagaaaatccacactgcagagaaa

SEQ ID NO: 2100 - DNA, 201 bp, Homo sapiens; identical to SEQ ID NO: 2092

SEQ ID NO: 2101 - DNA, 201 bp, Homo sapiens; identical to SEQ ID NO: 2093

SEQ ID NO: 2102 - DNA, 201 bp, Homo sapiens; identical to SEQ ID NO: 2094

SEQ ID NO: 2103 - DNA, 201 bp, Homo sapiens; identical to SEQ ID NO: 2095

SEQ ID NO: 2104 - DNA, 128 bp, Homo sapiens; identical to SEQ ID NO: 2096

SEQ ID NO: 2105 - DNA, 196 bp, Homo sapiens
ctagtcccgattatggttattacagtttgatgaaatgtggctgagatcattggcactgtggagattaagaaatgtgaggtcagagtgttgggtaarttgttcctgcgagtgttaaggttgtcaggataatggtgggaatggggtgaagatgacaactcagcaatgacacaagaagagagtgacacagaaagattca

SEQ ID NO: 2106 - DNA, 201 bp, Homo sapiens; identical to SEQ ID NO: 2097
  misc_feature (1)...(201): n = A,T,C or G, or insertion/deletion polymorphism (see Tables 1-2)

SEQ ID NO: 2107 - DNA, 201 bp, Homo sapiens; identical to SEQ ID NO: 2098

SEQ ID NO: 2108 - DNA, 201 bp, Homo sapiens; identical to SEQ ID NO: 2099

(The sequence listing continues in the following parts.)

What is claimed is:

1. A method of determining whether a human has an increased risk for RF-positive rheumatoid arthritis, comprising:
   a) detecting in nucleic acid from said human the presence of at least one T allele at a polymorphism in the PTPN22 gene at position 101 of SEQ ID NO: 36673, or at least one A allele at position 101 of the complement of SEQ ID NO: 36673; and
   b) correlating the presence of said T allele or said A allele with said human having said increased risk for RF-positive rheumatoid arthritis.

2. The method of claim 1, wherein said correlating is performed by computer software.

3. The method of claim 1, wherein said nucleic acid is a nucleic acid extract from a biological sample from said human.

4. The method of claim 3, wherein said biological sample is blood, saliva, or buccal cells.

5. The method of claim 3, further comprising preparing said nucleic acid extract from said biological sample prior to said detecting.

6. The method of claim 5, further comprising obtaining said biological sample from said human prior to said preparing.

7. The method of claim 1, wherein said detecting comprises nucleic acid amplification.

8. The method of claim 7, wherein said nucleic acid amplification is carried out by polymerase chain reaction.

9. The method of any one of claims 1 to 8, wherein said detecting is performed using sequencing, 5' nuclease digestion, molecular beacon assay, oligonucleotide ligation assay, size analysis, single-stranded conformation polymorphism analysis, or denaturing gradient gel electrophoresis (DGGE).

10. The method of any one of claims 1 to 8, wherein said detecting is performed using an allele-specific method.

11. The method of claim 10, wherein said allele-specific method is allele-specific probe hybridization, allele-specific primer extension, or allele-specific amplification.

12. The method of claim 10, wherein said allele-specific method detects said T allele or said A allele.

13. The method of claim 1 which is an automated method.

14. The method of claim 1 wherein said human is homozygous for said T allele or said A allele.

15. The method of claim 1 wherein said human is heterozygous for said T allele or said A allele.

16. The method of claim 1, wherein said detecting is performed using at least one detection reagent selected from the group consisting of detection reagents comprising the nucleotide sequences of SEQ ID NO: 49745, SEQ ID NO: 49746, and SEQ ID NO: 49747.

17. The method of claim 1, further comprising providing a report of the identity of said polymorphism.

18. The method of claim 1, further comprising providing a report of said human's risk for developing RF-positive rheumatoid arthritis.

19. The method of claim 18, wherein the report further shows the identity of said polymorphism.

20. The method of claim 17, wherein the report is computer readable medium form.

* * * * *